United States Patent 10,233,495 (METHODS AND COMPOSITIONS FOR SCREENING AND TREATING DEVELOPMENTAL DISORDERS) - sequence listing, part 24

SEQ ID NO: 152 - DNA, 633421 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacag

SEQ ID NO: 153 - DNA, 201458 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 154 - DNA, 195920 bp, Homo sapiens
cccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 155 - DNA, 57598 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaag

SEQ ID NO: 156 - DNA, 630046 bp, Homo sapiens
agaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacag

SEQ ID NO: 157 - DNA, 70380 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaata

SEQ ID NO: 158 - DNA, 17684 bp, Homo sapiens
cacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 159 - DNA, 15157 bp, Homo sapiens
cctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggcccc

SEQ ID NO: 160 - DNA, 16414 bp, Homo sapiens
cctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 161 - DNA, 12611 bp, Homo sapiens
gtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggc

SEQ ID NO: 162 - DNA, 28797 bp, Homo sapiens
cttcaaatttgccactttcctaagcagtcaacaatacttctcaagtatctaacggtcatgggggtatgggcaaaggaagccggtgaagcagtacaaggaagtatccatccccaggcctcctctccagttcacaaatggtctgcgtggatgggtcgctagtcagccaaggtagcagaacacacatatgaagagagctcagaccgcgactgctggagcccccttactaggtaatgatgggaacccccttactagggccaaagccctctggccgcccgcagcagtgtagatcagtggtaagaacttggacccaggagctagaatgccctggatttatatctgactctgccatttaatcctgttccttgggcaagtaactttatcttgagccttcaggttcctagtctgtaaaacagggctaagagttacgcagcagaaatgatagtagatgctaaatattccaagactcctttgaatttcccagcctcccttgcagaaggttagagggttgggatcatgtgactagttccagcaggtggtttgtgagtggagaaggcaggtcttccatggagaccttggatgctagtttttttttttttttttgagacagggtctcactctgttgcccatgctggagtgcagtggcacgatcataactcactgcagcttcagcctcccgagtagccaggactacatgcatgtgccaccatgtctggctaatttcttaaattttttttgtagcaatgaggtctcactatattgcccagggctggccttgaactcctgagctcacgagatcctctcagccgggcatggtgactcccactggtaatcccagcactttgcggaggttgcagtgagccgagattgtgccattgcacttcagcctgggcaatagcgtgagactctgtctcaaaaaaaaaaaaaaaaaaaaaaaaaaaaaaaaccaaaaaaacccccaaaacaactgatcctctctccttggcctcccgaagtgctgtgaatacatgcatgagccaccatgcccagccagaggccagtcttatagatggctacaggatggaagaagggtatcttgccccaaatcagactgtacataaagcattattgtgccaagccacgaaattccaggagttctgttgttacagccagtgttaattactctgtgacagctagtgttaatacagggagggctcacggaaataatggatacaaggccctctgagtgcggtgggggctgttattcttggctgttattccccaccaagacaggattcctcggttcatttcttaagcgaaacttcaaaagcagaagcaggctgggagtggtggctcacgtctgtaatcccaccactttgggaggccgaggcaggagaatctcttgagcccatgagttcaagaccagcctggacaacataaggacaacctgtctctataacaaatattaacaatacaaaattaaaaaaaaatagaaattaaaaaaaagcagaagcaggcaggtggggtgaggtggaagcttcatccatagggaagtcctgaggaaggcctgcctcccccggttccaggattgctctgtgcagctctagctctcccttaaccctcctccctattctgagttttcttctcttcccacttctccattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 163 - DNA, 31885 bp, Homo sapiens
gccagcctggtgactgacccaatactgtttcttttgctttttattgttaaaattacatactttggcttgaattctttcacttgcagctacaggagttgtgattccctcatggctccttgaggtaagcaaggggccctcactgccaaggcgactaggcacaaatgtggctcagcctcaccgagtgggagaaggaaggggctctagagccagcgagtctacacatgcaccctacgcacaggtggtgtgggcagggtggcagcacggggcattcccctgctatgtcccctctggagacctctctgtgcatgaaccttttgcctgaacacagaggttgtagggagccctccttggcccgtctgaggaaggcccctgtcataggctaagctgcttggaaaagctcagtcccctcccatgggtgaaggcaatggggcagcacacctggccgccagacaccactgcccactctgtccttcaggccaaagccctagggtcaaagggccagcccagtccaggaggaggcggcaggtcagctccctcttctccctccgggcctgtctttctcccaagctgagctgatagcctctcagcagggccagcctgtcccgggaagaagtaaaatgagaagtgtgtgttctgagccctgcccctggttcagagtatgttgtgtgggtggggtgactagaagctgggaaagagctgatctcccttgggcatgctgggcctctccttctagagaccctcctgtcctcacagacagagcagggcaaccccaccctcaccctgcacccctggctcaatggctcaggtccccctgctctgactctagcattgccaccaccaacccagctttccactgaggagccacctcaacaggggctattcccacagaccctcaagttcctttgcacgctgaccgccccatctccaatctgtatccccaacaagcagacaccatctccttgctgttctacccacagctactcactgtcacttccaaacctttgcccaccctgtacccctggttggaaacccttagtctctctgcttgccaaatcccagtcccccttcaaggcttagcaaaacagcgcggccctctcctgccagggtccgggacatacaaccttgaggcctccacctcctcacctccaaacacttcccactctggtcctcttctctaggaaggctttgctgatctatctttgcatatcaaactcttagggcacccactcgttcctcactctccccagattacttttagagttccttcaggaaggacttgagtaatgcgcaattttcatgaggtcagttttccccagaattttattttggatttcaaagactgataagacttccaaaaaattctgaggactaacagaatttgtgcacatatatttaatatattggccaaaagccagtttcggtggctcaagcctgtaatcccagcactttgggaggccggtggatcacctaagatcaggggttcaagaccagcctggccaacatggtgaaaccctgtctctactaaaaaaaatacaaaaaaattagccaggcgtggtggcgggcgcctgtaatcccagctacttgggaagctgaggcaggagaattgcttgaacctgggaggcagaggttgcagtgagccaagatggcacctctgcactccagcctgggtgacagcgcaagacttggtctcaaaaaaaaaaaaaaagtatatatatatatatatatatatatatgcgccaaaaaagaacatgaacaatgaaacaaaactactactgtatcgtggctattattgcttttttaaaatatatttttaaatattttattttattttttacctccaaataccatcaccattttatttaattattattacttttttgagacagtctatctctgtcacccagattggagtgcagtggcatggctcactgcagcctcaacctcccaggctcgagatcctctcacctcagcctcccatgtatttgggaccataggcagatgccaccatgcccagctaattcttttattttttgtagagacagaggtctcactttgttgccaggttggtcttgaacccctgatcgccattatttcataaaagcacattttaacaccaaagaagtagaaaagacataatttcagaataaataattactttttaaattaaatacatttccctgcctgggcaatatgttgagacgctacctctactaaaaatgcaagaattagctgggcgtggtggcgcgcgcctgtattctcagctacttggaggggggctgaggcaggagacttgcttgaacccaggaggcgaaggctgcagtgagcccagatcgcgctactgcactacagcctgggtgacacctcaaaaacaaatttttttttaataataataaattgaatatatttacctttaacaaaaacactactacattatccttattgttttcattttgctgcagaccagtgagaacattgtcatggaaaccaccacttgcaccaccagaaagatgcagaagaaaagaagtgagacgttagagactgtcagaggaggggaaggtgaagaggcaggaaatagggggtaagaagtccaccagcaaggtgctcccctgtcctgaactgacccccttctgctcactgaagtctgaggtggccagttttgggccctgggcagagctgtggccatgctcacaggtcaggcagctcagggattcccggcgctggagaccctggtgatcttgttcctactcccccgcaatgcagaggtaccctggacatgtgcctgtgaccggtgctggcaggccatggtacaggacttggagtcaggagcagagctaggcctggctctgctactcaccagctgagttactgggagaagtccctgccttctctgggcctcggtttcctcaactgaaaataaaggttctgaactagttgtttttgaggaaaccggaagatctctggcttaagaaaaaaaaaagccatgcccataatattttgtacagaattccaggggcttcaccacccctcagggccttcagtgggttccccaggggctgctaaccctgacacgcagttgctggccccttgccttcaaatttgccactttcctaagcagtcaacaatacttctcaagtatctaacggtcatgggggtatgggcaaaggaagccggtgaagcagtacaaggaagtatccatccccaggcctcctctccagttcacaaatggtctgcgtggatgggtcgctagtcagccaaggtagcagaacacacatatgaagagagctcagaccgcgactgctggagcccccttactaggtaatgatgggaacccccttactagggccaaagccctctggccgcccgcagcagtgtagatcagtggtaagaacttggacccaggagctagaatgccctggatttatatctgactctgccatttaatcctgttccttgggcaagtaactttatcttgagccttcaggttcctagtctgtaaaacagggctaagagttacgcagcagaaatgatagtagatgctaaatattccaagactcctttgaatttcccagcctcccttgcagaaggttagagggttgggatcatgtgactagttccagcaggtggtttgtgagtggagaaggcaggtcttccatggagaccttggatgctagtttttttttttttttttgagacagggtctcactctgttgcccatgctggagtgcagtggcacgatcataactcactgcagcttcagcctcccgagtagccaggactacatgcatgtgccaccatgtctggctaatttcttaaattttttttgtagcaatgaggtctcactatattgcccagggctggccttgaactcctgagctcacgagatcctctcagccgggcatggtgactcccactggtaatcccagcactttgcggaggttgcagtgagccgagattgtgccattgcacttcagcctgggcaatagcgtgagactctgtctcaaaaaaaaaaaaaaaaaaaaaaaaaaaaaaaaccaaaaaaacccccaaaacaactgatcctctctccttggcctcccgaagtgctgtgaatacatgcatgagccaccatgcccagccagaggccagtcttatagatggctacaggatggaagaagggtatcttgccccaaatcagactgtacataaagcattattgtgccaagccacgaaattccaggagttctgttgttacagccagtgttaattactctgtgacagctagtgttaatacagggagggctcacggaaataatggatacaaggccctctgagtgcggtgggggctgttattcttggctgttattccccaccaagacaggattcctcggttcatttcttaagcgaaacttcaaaagcagaagcaggctgggagtggtggctcacgtctgtaatcccaccactttgggaggccgaggcaggagaatctcttgagcccatgagttcaagaccagcctggacaacataaggacaacctgtctctataacaaatattaacaatacaaaattaaaaaaaaatagaaattaaaaaaaagcagaagcaggcaggtggggtgaggtggaagcttcatccatagggaagtcctgaggaaggcctgcctcccccggttccaggattgctctgtgcagctctagctctcccttaaccctcctccctattctgagttttcttctcttcccacttctccattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 164 - DNA, 10834 bp, Homo sapiens
gtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 165 - DNA, 30558 bp, Homo sapiens
ggatttcaaagactgataagacttccaaaaaattctgaggactaacagaatttgtgcacatatatttaatatattggccaaaagccagtttcggtggctcaagcctgtaatcccagcactttgggaggccggtggatcacctaagatcaggggttcaagaccagcctggccaacatggtgaaaccctgtctctactaaaaaaaatacaaaaaaattagccaggcgtggtggcgggcgcctgtaatcccagctacttgggaagctgaggcaggagaattgcttgaacctgggaggcagaggttgcagtgagccaagatggcacctctgcactccagcctgggtgacagcgcaagacttggtctcaaaaaaaaaaaaaaagtatatatatatatatatatatatatatgcgccaaaaaagaacatgaacaatgaaacaaaactactactgtatcgtggctattattgcttttttaaaatatatttttaaatattttattttattttttacctccaaataccatcaccattttatttaattattattacttttttgagacagtctatctctgtcacccagattggagtgcagtggcatggctcactgcagcctcaacctcccaggctcgagatcctctcacctcagcctcccatgtatttgggaccataggcagatgccaccatgcccagctaattcttttattttttgtagagacagaggtctcactttgttgccaggttggtcttgaacccctgatcgccattatttcataaaagcacattttaacaccaaagaagtagaaaagacataatttcagaataaataattactttttaaattaaatacatttccctgcctgggcaatatgttgagacgctacctctactaaaaatgcaagaattagctgggcgtggtggcgcgcgcctgtattctcagctacttggaggggggctgaggcaggagacttgcttgaacccaggaggcgaaggctgcagtgagcccagatcgcgctactgcactacagcctgggtgacacctcaaaaacaaatttttttttaataataataaattgaatatatttacctttaacaaaaacactactacattatccttattgttttcattttgctgcagaccagtgagaacattgtcatggaaaccaccacttgcaccaccagaaagatgcagaagaaaagaagtgagacgttagagactgtcagaggaggggaaggtgaagaggcaggaaatagggggtaagaagtccaccagcaaggtgctcccctgtcctgaactgacccccttctgctcactgaagtctgaggtggccagttttgggccctgggcagagctgtggccatgctcacaggtcaggcagctcagggattcccggcgctggagaccctggtgatcttgttcctactcccccgcaatgcagaggtaccctggacatgtgcctgtgaccggtgctggcaggccatggtacaggacttggagtcaggagcagagctaggcctggctctgctactcaccagctgagttactgggagaagtccctgccttctctgggcctcggtttcctcaactgaaaataaaggttctgaactagttgtttttgaggaaaccggaagatctctggcttaagaaaaaaaaaagccatgcccataatattttgtacagaattccaggggcttcaccacccctcagggccttcagtgggttccccaggggctgctaaccctgacacgcagttgctggccccttgccttcaaatttgccactttcctaagcagtcaacaatacttctcaagtatctaacggtcatgggggtatgggcaaaggaagccggtgaagcagtacaaggaagtatccatccccaggcctcctctccagttcacaaatggtctgcgtggatgggtcgctagtcagccaaggtagcagaacacacatatgaagagagctcagaccgcgactgctggagcccccttactaggtaatgatgggaacccccttactagggccaaagccctctggccgcccgcagcagtgtagatcagtggtaagaacttggacccaggagctagaatgccctggatttatatctgactctgccatttaatcctgttccttgggcaagtaactttatcttgagccttcaggttcctagtctgtaaaacagggctaagagttacgcagcagaaatgatagtagatgctaaatattccaagactcctttgaatttcccagcctcccttgcagaaggttagagggttgggatcatgtgactagttccagcaggtggtttgtgagtggagaaggcaggtcttccatggagaccttggatgctagtttttttttttttttttgagacagggtctcactctgttgcccatgctggagtgcagtggcacgatcataactcactgcagcttcagcctcccgagtagccaggactacatgcatgtgccaccatgtctggctaatttcttaaattttttttgtagcaatgaggtctcactatattgcccagggctggccttgaactcctgagctcacgagatcctctcagccgggcatggtgactcccactggtaatcccagcactttgcggaggttgcagtgagccgagattgtgccattgcacttcagcctgggcaatagcgtgagactctgtctcaaaaaaaaaaaaaaaaaaaaaaaaaaaaaaaaccaaaaaaacccccaaaacaactgatcctctctccttggcctcccgaagtgctgtgaatacatgcatgagccaccatgcccagccagaggccagtcttatagatggctacaggatggaagaagggtatcttgccccaaatcagactgtacataaagcattattgtgccaagccacgaaattccaggagttctgttgttacagccagtgttaattactctgtgacagctagtgttaatacagggagggctcacggaaataatggatacaaggccctctgagtgcggtgggggctgttattcttggctgttattccccaccaagacaggattcctcggttcatttcttaagcgaaacttcaaaagcagaagcaggctgggagtggtggctcacgtctgtaatcccaccactttgggaggccgaggcaggagaatctcttgagcccatgagttcaagaccagcctggacaacataaggacaacctgtctctataacaaatattaacaatacaaaattaaaaaaaaatagaaattaaaaaaaagcagaagcaggcaggtggggtgaggtggaagcttcatccatagggaagtcctgaggaaggcctgcctcccccggttccaggattgctctgtgcagctctagctctcccttaaccctcctccctattctgagttttcttctcttcccacttctccattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 166 - DNA, 20584 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggcccc

SEQ ID NO: 167 - DNA, 21735 bp, Homo sapiens
cctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 168 - DNA, 21904 bp, Homo sapiens
cacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggc

SEQ ID NO: 169 - DNA, 23618 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggc

SEQ ID NO: 170 - DNA, 20127 bp, Homo sapiens
cacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 171 - DNA, 21841 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtg

SEQ ID NO: 172 - DNA, 27162 bp, Homo sapiens
cattttgcccccacatcttgactttcacacaattcacagacaaatccttagacaattaatagaatgattaagactgcaagagatttaagacttagagaccatcttgtcccacctcctggttcttacagaagaggagaatggggcctgcagcgggtgtgagcagcccagagggtggggctggattatcccgaaggtaaggggagaatctggggctgcaagggcagacagagaatcaacatcaggaaggaagctctttttatttcagcatatatgttttgtgccgtttataaaaataaagttttgaggccaggtgcggtggctcacacctgtaatcccagcactttgggaggctgaagcaggaccatcacttgaggccaggagttagagaccagcctgggcgacatggggagacccccgtctctacagaaatttttaaaattatcccggcgtggtggcgcacacctgtagtcccagctactcgggaggctgaggcaggaggatcacttgaacctgggaggcggagatggcagtgagccgagatcacgccactgcactgggcgacagtgcgagactccgtctgtaaaataaataaatacaataaaatagagttttatcttacaataaaaatagagttttatcttacagtttcaagcttctacttggaagtaacacgtatggaggctcccagggcccctacagtctggaatcccgcccgtgcgagcctgagcgcctttcctccctccttcccttccgcaggcgtcctcgccctccacgtccctcctccgccggggtggcctggggcgccgggtcacgtggccggggaagaggttttatcccgcggcccctcggaaccccgccgctgctctgccgcccaggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaat

SEQ ID NO: 173 - DNA, 69 bp, Homo sapiens
cttaaaaggaggggctaaagaaagcatgtatcttccaaggtataagtgagtggtttcttcagctctgcc

SEQ ID NO: 174 - DNA, 60117 bp, Homo sapiens
acccaccaattaaataggtatgtcccacaatacacactgaaagatttctataccatcactgttctttctgtcctgtgtgccatcttcatcttcatttctcagctatatctatttttatttcttctctttaatatggccttgccccttgccacctttctgtaatacatttctggttttttgctattcacttatatggtatggttatgtgactacatatgaaatacataaacagggattgaaatttaagttgttataagtttaaaatagccggttataattatataattataaaatgttttaggtaaacctcacgataaccacgagacaaaaacctatagtaaatccacaaaagataaagagaaacaaataacagcatactaccacagaaaataattgaatcaccaatcaaaacagcaagagaggaagaaaggaacaaaaaaccctaaaaaacaaccagaaaatacttaacaaaatgtcaatactatgtccttaactgccaataattgccgtcatgtaaatggattaaattcttcaatacaaagatatagaatggctaactggattattaaaaatatatcccaaaaaagacccaactgtatgctgcctacaagaaattcacctcacctttaaggacacacagattgaaagtgaagagatgggaaaagacattctgtgcaaatggaaatgaaaagagagcagatatacttatatcagataaagtagacttaaagtcaaaaattgtgaaaagagagaaaggggtctttatattatgataaaaaggtcaattcatcaacaggatataacaattatcaatttatatgcacccaacattagagcacctaaatatagaaagcaaatattcatagatctaaagaaagagatagactgcaatagaataatatgaggggacttcagtcccccactttcaactatgaacagatcatccagagagaaaatcaatagaaaatattggacttgatatatacgttagactaaatggacctaacagacatatacagaatattccacccaacaacagtagaatgtcacttctatttaacatggtgctggaagtcctagccagaatacacattctggtcaggtgcacatgaaacactctccaggacaggccatagataaggccacaacatgagtcttaacaaatttgagaagactgaaatcatatcaagtatcctttctggccacaatggcatgaaacaagaaatcaacaacaggaggaatttttgaaaattcacaactatgtggaaattaaacaacatgctcctgaacaaccaatgggtcaaagaagaaatcataagggaaattgaaaaattactttgggacaaatgaaaatggaaatacaatataccaaaacttacaggatacaagagcagttctaagagagttttcatcaaaaaagatgaaagatcacaaatagactacctagcatccattacacctcaaggactggaaaaacaatcaactaagctagttacaaagttagtaggaagacggaaatgataaagatcagaagaagtaaacagaagatagaaaaaataaagagaccaaccaaactaagaattttttttaaaggtaaataaaatttacaaacctttagctagactgattaagaaaaaaaatgcaaagactcaaataaaatcagaaatgtaatcagaaatgaattgaagaggtaacgactgttaccacagaaatacaaaggattatttaaaaactactatgaacaattatatgccaacaaattggataacctaaaaactggataaattcctagacacatgcaacttgcaagacagaatcagaaactctgaacagagcaaaaacaagtaaggagattaaatcagtgataaatctaccatcagagaaaagcctaggacctgacaacttcactgctgaatttgatgaaacatttaaagaggaaataccagttcttctcgatctctttcaaaaaactgaagtagaggaaatactcccaaacacatttcacaaggccagcattaccgtgaacccattgcctgaggagagcactacaaagaaaaaaaaattacaaaccaatatccctgatgaacatgtatgcaaatatactcaacaaaatactagcgaattgaattcaacagcacatttaaacaattatttaccatgatcaagcaggatttatcacagggatacaaagatggttcaacttatacaaatctgtaaatgtgtgatccaccgtattaacagaatgaaagacaaaaaccatctcatcatctcaatagatgcagagaaagcatttgacaaaatttaacattccttcatgattaaaaactctcaaaaattaggtatagaaggaatgtaccttaacacaatagaggcctttataggacaaacccacatctaacatcatactcagtggggaaaaaaattgaaagctttccttttaagatcaggaataagacaaggatatccactcttgccacttctatttaacatagtactggaagtcctagccagagcaattaggcaagagaaagaaataaaagacatccaaattagaaaggaagaagttaaattgtccctgtttgtagatgacataatcctatatatagaaaaccctaaaaaactcaccaaaaatcaaaactgttagaaataaaaaacaatttcagtacagttgcagaatacaaaacaacatacaaaaatcaacatacaaaagctagcatttctatacactaatggcaacctaaccaaaataaaaaattttaaagatcccatttacagtagctacaaaaaatacttagaaataaatttaaccaaggaggtgaaaggtctgtatactgaaaactattaaacactgatgaaagaaattgaggaagacacaaatggaaagatatcctgtgtttatagattggaagaattaatattattaaaacatccatacccccccaaagtgatctacagattcagcgcaatctctatcaaaatcccaatgacatttttcacagaaatagaaaaaaaaaacccttaaaattcatatggaagcacaaaaggccccaaatagccaaagcaatcttgagcaaaaacaaaactggaggcatcatactacctgactttaaaaatatactacaaatatatagcaatcaaaacagcatagtactggtggaaaaacagacatataaaccagtggaacagaatagagagggcagaaataaatccacacatttatagtcaattaatttttgacagacgtgcctagacacataatgaggaaaggatagtctcttcaataaatggtgttgggacaactggatatctacatgcagaaaaatgataggaggcccttatctcataccacatacaaaaatcaactaaaaattgattgaagacaaacataagatgtgagactctaaaacttctagaagaaaacatatggggaatgctccataacattggtctgtgcaatgattttttggatatgaacccccccaaaagcaaaaagacaaaaatagataaataagattacatgaaactaaagaacttctgcacagccccccccaaaaaaaatcaacagtgaagagacaaccgatagattgggagaaaatatttgcaaaccatacttctgtaagtggttgatataaaaaatacatcaggaactcaactcaatagcaagaaaacaaataacccaattaaaacatggagaaaggaccttaatagacatttctcaaaggaagacacattgccaacaggcatatgaaaacttgcttaatgtcatttatcatcaggcacatgcaaatcaaaaccacacctgttaaaatggctgctatcaaaaaggcaaaagataacaggtgttggcaagaatgtggagaaaagagaatccttgtacgttgttggtaggaatgtaaattagtgcagctgttttgtacagcagttcctcaaaaaactaaaaagagcactatcatatgatccagcaatcccacttctgggtatatgttcaaaaatcgggctattgaagagatacctgcactctcatgttcattgcagaattactactaaagtagctgaatcaacctaagcgtctatcagcagatgaatggataaagaaaatattacaactgcacaatgaaatactattcagtcttttaaaaaacagaaatcctgtcattttcgatgtcgatgaacctggagggcattgtgttaagtgaaataagccaggcgcagaaagacaaatactgcacgatctcacttaaatgtgaactctaataaacgtcaaactcatcaaagcagagagtagaatggtagttaccaggggctaggggaggagatgggaggtaggaatggaattagagagatgtttgtcaaaggacacaaaatttcagttaaacaggaggaataaggtcagatctactgtgccgtatggtgactacagttaataataagtgtattctgtactttatagttgctaaaagagtagacttaagtgttcccatcacacacacacactaagtaatagatacgttaattagctcgagttaaccattccacaatgtatgcatatatgaaaacatcatgttgtacatcataaatatatacattttgtacttgtcaactaaaaaaattgtaaaaaccagtatttaatgctcatctcaaaatataaaaagcctgtgatgcaaagggtttctatggtgtagtcgttaccacgctggcctaacacatggaaggtcctctatttgaaactcaacggaaacaacaggtttctctggtctcccagaatctgaccgggagtggccgcttcttcccgggagtccagagctgcaaggaacaagtgataatcccgcctcttttaaaagaaagatcgtcatcctgggatagctgtgccaaattagcaggccgctctgggcgggcgctccccagctgggacgtgctcgcttctctccctgaaaatctggaacgtgaaatcttacagcaccagacttttccagtgtccactttctcctggttacgttttcccctctccctcgcagaggaatagccatcatgcccttgcccttggccatttttgagtagactcgccttaggtcgagtcctggttccccactaataatcgagacatttcctttgttccgagacgcaagaaatggtgggtagtcgcgcacatctactcctgaataaaggaaagggcagaaagttttgcggtaggtgacgagtgagcgcaagtggtagagtactcgcttagcatgtgagaggtagtgggatcgatgttgtcacttggggccgcatgtccatacagtacaacgtggagaacggcttcattagtcacctgtcgaagaaaacgaggaagtaccagccatcttgaatgcttcactggtaaaagacctatgggcataaagaaacagtgctaataatagcccctaaaacgttcagtggacagtacccattttctaagttgttttctctttattcagaggaaagaggagatcccaagagggtgggatatacccaattgttccttttctctccttcctgcagcttgacccaaaatgccaaaatgcagcacagctctggaaaatgcagggcagagcaggatgagtaaaaccccagctttctttctggtcagggcgctgtaaagtggagttccgagtcaccgggaagtcctgctgagagtgtggaaagcaaacccacaagtggtttgtcaactcaccgagtgcacccctgagttgcgaatatgtagctgtaaagagcaaaaccaaatacagaaagcttattttttcccaatttaaaaacatgttttgtgattctactttagacatcttgaataggcaaattcatgtagacagaaagaatagaggttgttggggagagggaaatgtggagttattgtttaatgggtacagagttgctgtttgggatgctgagaaacttctggaaatgggtagtggtgatagttgctcacattgtaaatgtacgtaatgccactaaattgaacacttagaattttaaatgtaaaatgggttaagtatattttaccacaataagaaaacacaaactcttgttcattctgtaatttagcacatagtctcatcatctgtttttctccacaccagctcatctgttcatccttctattcatttgacaaatacttagaaatgtctagatttattgttccattcatcagacattaattcaggatctcttgtgtgccacagtgtcaagacttctccctcaaatgtttacaccaatgtcttgacaaataccatagatctttcctgcacagcctctccagaatgtttttcttacctttcactcatgtttctcttgcccattctaccacgtttatggaggacgtagtctgcaccacaaagtataatgggcactggagctacggaaagactcatgctgttcacttcagaagctgacggaataaatgtgaataaacctcaattctttaatctatttataacttctttccatttctcttcaattacagtcttcctgttcccaagctctttgacatccaacactaaacacctttttcttaaatgttaatttggttatgtaagctgtctgcaattttttcaagggttcttaagtctcaatgttttcccaatcattatctccatgtgcacaggcatttcaatcactacttcctttcattttataaacaggcacacacacaagcaggcacatatgcacttgtgcactacacatcccaagtgaacaggcatgtttcctcacacaggaattcctacatctatgcctgttccttcaaactcatgtgcattcttcctcatctgcatccttcaaggttcatatttatccctttactacaaactgatcttttaatccccatggttcttgtctgtaatacttttgtgatttttgctgttttcttatgtgatgtgaatatgtgagttctatatgatgtaacttaaaaagacttgaatataagtatgtgtatatatatatatatataaatctaacataaatatatcctatatatcttagaaatctaagatatatacataccttgaatatcttagatatatctatcttagatttaggaagtctgagggtttcctcagtgtagtgtagaggttatctcactcacttgcctaacacgagatgaggccctcagatagaaagacagatgttatataattataaagcgtctattcaccgaagggacacaactgtcctaaatatgtctgtttctggccacagagcttcaaaacttatgaacaaaatggataaaccagaaagaaaatagaaaaatccaattacagttgcagacgttaacactcctctctcagtaattgatagattcaggagaaaacaaatcagcaaacattttagagaacagaacaacaccatccaccaatggatctaatagactttataaagcaaaatcacaatttatgtagaaaggcgagccaaaaaaatcaaagaaaagcaagatcatattataagtaggaaatcacgaatggtcagagtgcagaaaagtgacattattgaaactgatatttctgaaacagttacttaaatagcaggaagaccgataacggcgaatctgtaagtgaatctttccttgtccatatgtatcctgctttttcttgaggtctgggctggccaaatgtctcctgaaattcctgggcctactacagtgtctggcacagagcatctctccagcaaatatgtactgaatgagtagaaaggaactgacggattcagaagagacctgcaagaataatgttcagtatttggcaaatcactgaatgtggtgtttgaaggaggacaatgagtcaaagttgacttggaaatctaggcccaggaggaggttgagaattagatatgtggtatatgaatgaatggactactgtggagaaaaacaggcagagagataatgagcaggagcagagaaaagactcaccttttggaatctaaaataaatgtgcttgtcagttcaggctttgccacctagcatctctggcaccttagaaacaataattatctgagcctccagtacatctagaaagtgcacattaggatacatcgttttgttagcgaaattcaactggactacgtaaacgcaagaaatctcgtagtatacttaatagcacacaagaaaaaacaaaggggtaaaaaacaaagagggtgccattataagtattttgtgtttttttttgtagcggcaatgtcttcagtcatgtagatgcaagtggagatatgaaggaagacagtagtatgatcaagagacaggtttgatggctatttcttcattcatttatccaggtggtcagtgaactatcatgaactgagaacctcctgtctcttttcaacagaggagactatggaaagtgtaagagtgactaaggtttctgagggaaggaaaagggaaaaagagcagcaaaagacaggtacaattgatcctggtaacgcagaacccagacggtcctatgaaatactggaaaggcgtagactcctctggtcgtgggtatggaatcttcctagtgcagcgttgattgatacagagtaattttcaagtaggattgattgtagtttttgaaagctgaaaccgtaacgtaggtgggaaatacacttcgacaaaatggatgttgcccgagctcaacagcaagccctcttagcgcagctggcagcgcgtcagtctcataatctgaaggtcctgagttcaagcctcagagagggcatcacttctgccaaagaagttggatacactaaatatcggaacgcaacgcaaatgctatagcagataaggatttgaagactgacccaatatttgtagaaaatggaaatataatttaggttttcttgttttttcgactttccagtggtttgagtaaaatgagtggtgaaaacagaagagtagattacaccagaaactacaagctatgtcatataattggtctttctagctgacacaggaagcaggggaaatttctcttccaacttcccgctctcagggtcacctcacactaattattgggtggatgggtgaagtcatttattcttttaatcatccaacaaatatttcttgaacacatatcttgttaagagactggggtcaagagtgaatacaacgcaaacattcctaccactgtgaaactacatcctacttgggaggagtggggtgaaagtgtattcagcacaaatattcctactattgcgaaactacatcatacttgggaggagtggggagaaacagacaggaaacaatcaaaaatatgtaagaagtgatttgacgatgtctactgtgagggaatcgctaggcagtaaagggtttgggaatgtggaggtggcacattcagctttcaggaggacaatcagggactctgtcaccttgacaactttagccttgccttcttctagccatcttgctggaacacttgtgcccgtgtttttctaacactgtcataagagtacttttacctatcaaggcaactgggggttaggagagctttttgcccagaaggctagttggcttccttggaaaactgatgatacatgaggactggggttgtcaatccctcacatgtttcttcatatgaaaaatgaggactgtgggattctctggctggatctcagcacctagagatggatctgggcaataggaactgctcagtattagctaccgctttggttgccttctccttgtggaaagctggcctctcacactgaatttgtatcataggcactcatgagggtcttgactacatcaatatctgatgggagactttagggcagttctgttgtcgtagctgatttgctcatttggtagctagcatccagcttcttgtgaacattaaaataaaataaaataaaataataaaataaaataaaataaaatagattatggaggaatagaatacagatacatactaaggcataattttccagacaaaatggatttggataaaagaatctaattaagaatttgtgcatggttcttttaaaattcctttgatttttttttttttttttggcctgtttttcaagtgtccaatttttgtcacccttctcccatcaggtcagagagatagccaatggtcagaagcaatcttccagcaactgccatagcgctttctcctgcctgcagatgcctctttttagtcagcctttatgggaagtagcagcaccatccgttcccagagagcaagctctggagtagctgagctaaccccagttgctaatctgagctaatcccagttaccccagtggatttacagattgagggtagaacccagcagggttctcttcttggaaagaataggcttccctctaaggtttcacatagatactgggtgaggaaacagccctaaatggcttcagaaattgaatgttctttgggcaaagcaggaagccctgctgtggaagagcatcatttgagcataaatcaggttatcaggacaaacagagtgttcaggaggtctagatggttaagcagagagcctcatcagaatatccgtggtgaagagaaacaatcttgctgggagaaggataaccgtaactggggacttagaataaaggctaaaaatgattcaaagagaatgcaaaaagaatcaggcacaaatctttactatattctgttgtgcaaatctcaccttactatgtgtttatattctattcctccacaatctttattttatttttatgttcacagagacttgctggttccaactaaatgagcacaacagccagtgacaacagaactgcacttaaatagtccctcatcagctcttgagagcagattccttaaaggtgaacaatattccacatacaaggacttttcagcagtatgcattagaaatggaactgaatgtttattattctttatataagttggttgatacgacttttcagcttccctcagtaacattatctaaattttgtagatgacagtaaagctcagaggagttaaaccattttcctcaaatcacgtagctttaaacaggaaaaccagatatgaaaagcagatttctttctaaattaaaaaacaaaaacaaaaaaacttgagctcttgctttaccctagcacatagtctcgccatctgttttctccacaccaggtcattcatgtaacattcattcacataacaaatacaaataaatgagcggattcattcatcagatattaattcagaatctcttttgtgtctaccacactaggctcaagacgtcccagtgtctttgtctcctctccctcaaatctctccacccaatatcttgacaaataaagtagatccttcctgtacaacgtctccagaatcttttcttccttttctttcacctctgtcatcattcatgctacagtgtttacggaggatgtgttctgcagcatgaagtgtcgtgggcactagctctgcagaaagacttctgctgtccacctcaggtgctgacatgataaatgtgggtaaacctcaatcctttaatatctttatgacttctttccctttctccccagttcctgttttctcatgttcaagctctgacattcaaaactaaacacctttctctaacatgttgctttaattatttaagcattctgcctgggatattttcagttagtcatgggatttttcataaaactctcccaatatatctccaagtggccaggcttttcaatcactgcttccctccatgtgtatttcacacacacacacacacacacacacacacactctccacttaaattgaacaggtttatttctttacacaagaattcttacaaacagcccggttttctccaccatatgtccactccttctctgcatagctcaattttgattcttacactatattttacatattcttacactctgatacgatcttgtctcttattctttatggctctgctctgtaattttgttgttgttgttctgaaatatagttggacatgtaacttgtacatgacacaccttagcaaggaggcaactcatatctcagatgtaagtgaaagaagcactctccaggggtttcctatgggagtggtcagcacgctggcctcattggtggaatggcctagttacgaaaacagcaggagctttttgccttccagaaatctggaccatctcacaacccccagacagtctcagctacaaggaaaagtgataattccatcccacttttataaacacacacaaacacacacacacacacacacacacacacacacacacaatcatttaatcatttttaatcatttaatcatttttttaaaatctctgacactttagctgggcaggtctagacatgtcctcctttgctgggatgtgcctttttctgtcccggaataccctaaacttgacattttggcagcacgagttttccctttgtgactttctccttgttccctttctcctccttctttgcagagaatgagtagccactgcgccttgccctgggccatcagtgagaagacctgctcttagtagagccctgctttcccgctgaaggccttgaaatcccctgtgttccaggacacccactaaagatcaagaaagctcccctgacgtggggaattagctcaagcggtagagcgcttgcttagcatgcaagaggtagtgggatcgatgcccacattctccaagctttattatttggaccttgggtctccaaacactcaagtatccaaacccaagttagtgtctgagagcaggatgctgctttggttcaagacataggagcagcaacaatacaggcctggtgatggctccctcctggcattcagtatagtgtagatctactgtgtaattcatttgctgtttcctcaaggagctgtgaaaccaagggacatatacaactgctcttttctccctgtttctgcctgcagcttggtcctaaacctcagacaatcgtgaaatgtgcagggcagagccacctgggtaaacacagcctcggctttctgctcaggggactgaaaccaggatgtgtcaagtaactagaatgtgcctggacagatactgtagaaagcaaacccataaagttgttcatgagcttgtggacacacctgccagctgtgaataagtggctctaatcccaaacaacttacctacaaagagcctgagagctgaactgcgcaatggcccactttccagtcctcactgaagttgcacacactccggaaatctctgaacagtggcgtaaaggctttgcaaatagagttatctttgaaacaacaacacgtggaaggctggttggtacttggaacttgaatacaaggcaattttgtgcctgcaaaaacaaaaatagcaatattattcttaagatttcaacaaaacacagtgtctcatcacataatccaaagaagtccaggttacaagccccaaaatcttcggcattatgaaaaaaacagggagatcttcattcacatggcaaagagactcctcgaataacaatactgagaggacacagatgtcaaaatcatctgacgcatacagtggagcagttatgataacaatgctcctagaattaggggataacattcgtgaagtgaatggaaagttggaaagtctcagcaaatatctggaatatataaacaccaattttaagcttaagaatttaaaaaaatgtattaaccaaaactcttaggggaaataaaaagcttaactggatgatctcgataacagaatgcagatgactaagaaaaagtcaacgaacttgaaaacagaacaagaatacctacataatctgagctatagagagaaaggagtatttctgtaaatgaacagaggctcagggacaaattaaaaaatagcaaatctaacattcacattattgtaatctgaaaagaagaggacaaagaggtctttgtgggataaaactttgaagaattaatggctgaaaatgtatcaaatttgtcaaaagatataaaccaggtttttaaagttcagcaaaggtcaagcaggataaacccaaagaaacccaacccatttcaagacgtatcataatcaaactgctgaaaacgaggaaagtacaaaacaatcttgaaagcagtcaaaggaaaatgaaaaagaaactaccatatgaatgagtgtagatttctcatcaggaaccatagcggccagaaaaaaatgtcataatgttcagtaagtaacaaaagaaaaagacctatcaacccagaatgctatgtggagcaaaagtatctttcagacataaaggcaaataaatgcattctcattggaaggtaagtcaatacattctcattcttagcaagaatgctggaaaagaattagcaaagatttgagataagaaaagtgataccagaaggaaacttagaacatcgtcaatgaaggaacgaaagcagaaatagaaaatgtctgggtagacataacagactgttcttcttctcctgagttccttaaggtatgtttgatgattgaaagccaaaattgtaactttatcagaagcagttgtcattgtatcgagatgtactacatagataagataaaagggtaagtgtaatgggcctaactcttgatgaagtttctatattcaacttgaatggtaaaatattgattctaagtatactgtgaaaagttatatacgtatatggtaatccctagaccacttactaaccagattgaaataaaccaaaacaagatagacagaggaacatagaagaattaaaacaaagggaacaaaggttaatacattattaaatagatctatctaaaaacttatctatattaacattacacgtaaatgatctaaatccttaattaaaaactagagatcatcagaatgtattaaaagtaaatatgctgactgtaagaaagccacctgcaatacacttatatatcagaataaaagttatatagcagattgaaggaaaagagtgggaaagatacctcatgcaagcattaatcaaagacagctgtggtgtatacattaaaatcagacaaagtagatttgaaagcagagaaacttttcaggaataatgaaggctgctagataattacgaatgtccattctccagggaatactgttccaaatgtatatgaggacacagattttcaaaactcataaacaaaattagataagccaggtaaaaatagaaatatccaattttagttgaagacactaaaactcctctctcagtcattggtagacttagtagacaacaaatcagccaacatattggagaactgaaccacaccatccaccaatggatctgatcaacttcataacgcaaaataaaaatttagccagaaagcaaagacaaaaattaaaagaaaagtaagatcatgttataaccaggaaattaagagtggtccatcatatagaagggtgctattattgaaagagtttgaaatagtgacttagttattttgaaagagttttgaaggcattatttagctggaaatgacagaaagactgaaaatggtgaatctggaggtggatcttccctcatctatatttatcttgttttcttttgaggtctagggtgtctatacttcctctgaattacctgatcctactacagtgtctggcacagagcatctccccagtgaatatgtactaaatgagtggaaagtaattgatagattcaaaagagttgtgcaagaataatgttcattatttggcaaatcattgaatgtggtgtttgatggaagacaatgaatcaaagttgacttgaaaggtaagcccaaggccagacgtggtggctcatttctgtaatcccagcactttgggaggccgaggtgggcagatcccttgacgccaggagtttgagaccagcctgggcaacccagtgaaatcctgtctctacaaaaaaaaacaaaaattagccgggtgtggtggtatgcatctgtagttccagctactcaggaggctgaggtgggagcatcactggaacccgggaggcggaggttgcagtgaacagagatcacaccagtgccctggcagtaaagtgacaccttgtcttaaaatgaaatgaaatgaaatgaaataaaataaaataaaataaataaaataaaataaaataaaataaaataaaatataaaagttaagcccaggccgggcgcagtggctcgcacctgtaatcccagcactttgggagaccaaggcaggcagatcacctgaggtcaggagtttgagaccagcctggccaacatggtggaaccccgtctctactaaaaattcaaaaactagcggggcacctgtagtcctagctactcgggaggctgaggcagaagaatcacttgaacccaggaggcagaggttgcagtgagccaagattgtgccactacactgcagcctgggcaacagagtgagactccaactcaaaaaaatttttaaaaaaaatttttaaaaagttaagcccaaaaggtaagtaaagaggaggtctggaattagatatttggtgtatgagtgaatgagctaaagtgcaaaagaatgggcagaataaccgtgagctggagcagagggaaaaaaatcacatgcaaaatctaaaaatatctgcttctcaattcgggctttcccacttagcagctttggcatttaaaaaaaaaaaaaaaaaaaaaaaaacacttgaccgggcacggtggctcacgcctgtaatcccagcactttgggaggccgaggcgggcggatcaggaggtcaagagatagagaccattctggctaacacggtgaaaccctgtctctactgaaaaaatacaaaaaaattagccgggcatggtggcgggtgcctgtagtcccagctactcgggaggctgaggcaggagaatggcctgaacctgggaggcggagcttgcagtgagcccagatcgggccactgcactccagcctgggagacagagcgagactccgtctcacagaacaaacaaacaacaaacaacaacaacaaaaacgcacttagcctatctgattctctattacttctaaaaagtgcatactaaggcataattttgttggcaaaagtcaatcagactacatcaagtaaactccctaagtctcctagtataattcacggcacaaaaatatgaggaaaaacagggaggatatgattaaaagtttagtttgtattttttgttgagtgaatgtctccagtcatagagatgcaagtgtagatacacagtaagagtagtatgaatggcagacaccttggaaggctatttcttccttcattcattcagttggtcactcaatgaactatcatgaattgagcactacctctgtttcttatcaacaaaggagactacggaaaggaagaatgactaagatctctgaagaagggaaaagctagatgactgggccacaagaggaaaaaaagcagcaagacaggtacaattgtgtctagtccctcaagccagaaggtcctatcattatgtgaatactggaaacgggtggactccacctgtcctgagtggggaattcttccagtgcagcattgactgataaggagtgatttccaagtagcattgattgtgttctttaaaagctaggaattgataaagcagcagtgcgtgggaaatgagatttaataatctggatgtcacctcttaggaacagttgctctcttagagcagcaggccacctgtcaatctcgtattctgaaggtcctgagtttgaacatgagacaaggcacagcttatgccgctatttccattaagagaaatgaaataggtgtgataaataatggaacacaaatgctatgagataatgatttcaagacagaccaaatattagcttaaaatttaaaagtgagttttcttttcttttctttctttctttttctctttctttctttctttctttctttctttctttctttctttctttctttctttcttccttgcttccttccttccttctttccttccttccttccttccttctttcctttcctttctctgtctgtctttatttattttttccttcttttggcttctcagtcgcttgagtacaaggcgtggtgaaggcatataaattacaccagaaactgcaagctatgtcttatgtctacctctctagctgacaggggaggcaggggaaatttctcttccaattgcctgctctgaaggtcatccaaacataattatggggtggggtgggtaaagtcttttattcttttaatcgtccaaccgatagttctcaacacatatcttgttaagagactgttttgggtatagcaattcgcagtgaataaaatacagatattctcacctttgtgatactacgtcaatgttggggggagtggggagaaagagacagaagcaaaaaagaaaaataaacaagaagtcatgtgatattatctactgggagggagtcattaggcagtaaaggactcggcagtgtggaggtgacacattcacttttcaggagaagaatcagggaagttgtcaccttgaagatatcatttagcttccctttcttccaatagtctttctttacatgggaaatgaggactctaggattctccggctggatctcagcacctagagatggatctgggcaataggaactgctcagtaagcattacctactgctttggttgccttctccctggcctcttggattgagcttgcatcatacgtgttcagtaggaacttgcttagtggatttacaggttgaggttagaactcaccgggattctcttcctggagagaacaggcttccctctaaggtttcatatagaccccgggtgaggaaagagccctaaatggcttgaaaaattgaatgctctttgggcaaagcaagaagcgccactatggaagggcatcatttgggcctatatcagggtctcagtacaaagatgagtgctcacgtggtcaagatggttaagcagagaatctgaccagaatgttcacggtgcaaagaaataatcttgttgggagaaggatcacaacaattggggaattagaatacaggctaaatgagactcaaaaataatacaacaagaatcaggcacaaatcctttactactacattcttttgtacaaatccattttgcctagaaaatcataccttactatgcatccctattgtgtttctccaccatctattttactttttaaactttatttcatttttatcatcacagaagcttattgctacaaaacaaatgagcaaatcagccaatggcaacaaaactgcactgatctctctccttagaccttcagaacattttccttaaaggtgaacaatactccacgttcaagaatttttcagctctatgtgctagaaactatactgactgtttattaatttttatgtaagttggtcgatatagtttttcagcttccccaagtattattaccctagtgttacagatgacactgaagctcagagcagttaaaccattttccttagatcacataactttaaagagggaaaccagatatgagaagcagatttctttctcaatgaaaaaaatcacaagctcttcttgctttagtctagcacatagtcttatcatctattttcttcacaccagctcactcatgtaacattcattcatttaccaaatacagataaatgagtggatttattcttgcatcgatcagatatgaattcaaaatctcttctgtgtctgccacaccgggctcaagacttgccagtgcctttgtctcctctccctcaaatctctccacccaatgtcttgacaaatactgtagatccttcctgcataaactctgcagaatctttttcttctgttttactcacctccttctttatccatgctatgatgttcatggaggatgttttcttcaccatgaagtgtgaaggggattgaagctgcagaaagactcatgctgttcacctcaggaactgacacagtcaatgtggataaatctcaatcctttaatatctttatgacttctttctctttctccccagatccagtttttccattttcaagttctttgacatttaaaactaaaaacctttccctaaaatgctgcttttctacctggaattttttcaatgagtctttagcttttataatattctcccaacatatctccaagcatccaggcttttcaatcactacttccctccgtgtatattttacacacacacacacacacacacacacacacacactccacttaaattgaacaggcatatttctttacacaggaattcctacaaacattccaccctatacctaccctaggttttctccaccctatgtccactctttctctgcattgctgaatgtgttttctttattctttcactctgatatgatctttgtctcttattctttatgcctcttatctgcatttttttgttattattgttctgccatgcagttggatatgtaacttttacatgacacaccttagcaagaagacaacacatgtctcagatgtaagtaagaaaaacactctccagggatttcctggtgtagtgctcagcaccctggcctcattcctgaaagtccctcggtgtggaaaaagcaggagctctttgccttccagaaatctgcatcatcccacagcctcagctacaagaaacaagtgacaatgccatctcttttcttttaaaaaaatcatttaagcttcctgagatatctgtgacacattagctgggcagggtccttctgtgggacatgtcattttccgtctcggaatatgtgaaacttgacattttggcaacaccagagttttccctttgtgactttctccttgttcccttttctcctccctcctcacagagaataagtacccactgcactcttgccctgggccatcaatgagaagatctgctcttagtggagccctgctttcgcggtgaaggccttgaagtcgcgtgtgttctagactgcccactaaggatgaaaaaagatgctgtgagatgaagaagtagctcaagtggtggagtgctcgcttagcatgtgagaggtagtgggattgatgcccacattctccaggtttcactagtcggacctcaggtctccaggttacagtggaaaaaaatatgtgttagacactgatctcagaaaacagtaagttagacactcatctcagtagcagcctggacacttctttggctcattatgtaagggcagcaacaatacgggcttgactaagattctactggtatgtggtatagtatagatctatcgatgtgtaattagttttctgtttctttgaggagctgtgatacaaagggacatatccagttgcacttattctccctgtttcctcctgcagcttggtcctaaatgcagcataattatggaaagcgcagggcagagccactcaggtaaatacagccccagctttctgatcgggagaccgaaactaggagttgccaagtaaccaggaaagacactgtggagagcaaacctgtcaagttgtatgtgaactcctggatgcgcctgtgagctgtgaataagtggctctgatcaaagacaacttatctaaaaagagcctgagaatcgaactaagtgatagcctactttccagtcctcactggccactgggttgcacatactccagagtctctgaatagcagtgttaaggctttgaaaatagaatcgactttgaaactacaacacacaaggctggctggttattggaacttgaacacaaggcaatcacatgcctgcaaaaacaaaaatagcaatattatccttaagatttcaacaagacacagtgtctcatcacataatgcaaagtacaaccccaaaatattcagcatatgaagaaccagggcaatcttaattcacttggcaaagagaatcctcgaataacaatactgagaagacacagatgttacaatcatctgacacatacttttaagcagttattacaacaatgctccatgaatgaaaggataacactcttgaagtgaatggaaagttgggaagtcttagcaagtatctggaagctctaaacactgattttaaacttaaaaattaaaaaatgtattcatcaaaactattaggagaaaaaaaacttcaatgggttatttcaataacaaaattgagacactcagaataaagtcaatgaacttgaaaacagaacaaaaataccaacctaacctgaacaatagagaaaaaggagtgcttttgcaaatgaacagagcctcccggacaaacagaaaaataagaaaaatctaacacatcattgtaatcctgcaggaagaagagaaagaggtcctccagaaagaaaactccgaagaattaatggctgaaaacatatcaaatttatcaaaacactttagaagttcaataaatgtcaagtaggttaaacccaaagaaatccatacccagacacatcataatcaaactgctgaaaactaaggaaaaccataaaaatcttgaaggcagccaaatgaaaataaaagggaaactgccacttgaatgactgtggacttctcatcagaaaccataggggcccaaggaaacatttactaaataccaaaagaaaagacctgtcaacccagaatgctatgtagagcaaaaatatctttcagactaaaggtaaataaatacattctcacaggaaggtaaactgagagaattcattgctggtagaactgctggacaagaattagcaacgatttaagatgagaaaaatgataccagaaagagacaggacaccatcagtgaaggaacgaaagccgaaatagaaaatgtctgggtagacattacagactattattcttctcttgagttccttaaggtatgtttcatgattgaaagcaaaaattgtaactttatctgatgcagttgccattgtatctagatgtgctacatacataacataaaagggtaaaggtaaagggcctaactgctgatgaagtttctatattcaacttgaatggtaaaatattgattctacgtatactgtgaaaggttatatatgtatatggtgatccctagaccacttaggaaccagatttaaataaaccaaaataaactaggaagaagaacatagaagaattaagacaaggggaacaaatgattaataaattattaaaaagtagatctatcggctgggcacggcgtctcacgcctgtaatcccagcactttgggaggccgaggtggctggatcacctgatgtcaggagtttgagaccagcctggccagcatggtgaaaccctgtctctactaaaaatacaaaaaattagccaggcatgaagccgggtgcctgtaatcccagctacttgggaggctgagacaggagaatcacttgaacctgggaggcagaggttgcagtgaggggagattgcaccatggcactccagcctgggtggcaagagcaagactccatctcagaaagaaaaacaatagatctacctaaaaacttatctataaaaacattaaatgtaaatgatctaaaacaatgaattgaaaaccagaaattgtcagaatgtattataaatgaatatgctgactacaggaaagtcactagtaatatacttatatgtgagattaaaagttatatagcatattgaaagtaaagaatgggaaaagatatgtcatttaggcattactcaaagaaagctgtggtggatatattcaaatcagacaaaccagattttaaattgtagaaaacttccagggataaagggggctgttacataattagaggtgccaacacaccagagaaataatgtcccaaatgcatataaggacacagggcttcaaaactcgtaagcaaaattggataatccagataaaaatagaaaaatccaattacatttgcagacgttaacagtcccctctcagtaactgatagatccagtagacaataaatcagtaaacacatttgagacccgaacaacatccatacagcaatggatctaatcaatcaactttctacagcaaaatcacaatttgggtagaaagaagagaaaaaaaataaaagaaaaacaagatcatgctataactaggaaatcaggaatgttcagggtgcaaaagagtgatatattgaaactgacatttttgaaagggttatttagctgtaaatgacatgacacggagactgaaatcgtaaaactggacgtggatcttcccttctccatatttgtcctgccttctcttgaggtctgggctgcttgaatctttagaatctcctgaacttaccacagtgtctggcacagagcatcttccctgtgaatgtgtactgaatcaatggaaaggaattgacaggttcaaaaatgttgtgcaggaataatgtttactatttcacaaatcactggatgtggtgtttgaaggagaaaaatgtgtcaaaagttgacttggaaacaaagcccaaaaggtaagtgaaggggatttggggaatgagatatttggtgtgtgaatgaatggggtgctgtggagaggagtagggagtaagattgtgaactggagcagagaaagaatcacgttttaaaatctaaaacatcttctcctcagttcaagctttgacacttagcagctctggcaccttggaaacaaaacttatctgaggttccattacttctagaaagtccagattaggacacatagttttgttggtgaaactctgttggactacatgaagtaaattcaataaatctcttagtataattaatggcatacaagatttgctttacactttttgtagcaggattgtctccagtcgtgtagatgcaagaggagatagagagtaagacacagtagtatggacaggagacacctttaaagactattttttcattccttcattcgttcagttggtcagtcagtgaactattatggactgaacatgtcctgtgtgtcttttcaaaaaaggacaccataggaggtgtaagagtgattaagatctctgaaggagggagaagtcagatcactgggccacaagagggaaaaagtcagcaaaacaggtacaattgttcttggcctcttgcctcaagatggtcgtcttgttagatgaatactagaaatgggtagattccacctgtcctgaggataaaattctttgggtgcaggattggctgataaagagtgatttccaagcaccattgattgtgttctttgaaagttaggaactgataaagcagcagtgcttgggaaaatagcacgtgggatgtcaattcttgggtgagaaccgccctctttctgcagcaggccacacatcaatctcataatctaaaggttttgagtttgaacatcagagaggatacagtttttgctgctatttcagttgagggaaacaaaatgggtgcactaaataatgaaatgcaaatgctatgagataacagtttgaagactgactcaacattagcttagaatggaaaagtgatttcggttttttggagtttttttgttgttgtttgtttgttttttggcttgtcagtggtttgagtaaaatgagtggtaaagggatatagattacagaagaaactgcaagctatatcatataattggtctttctcactagctgatggaagaaacaggaaattttttgtcgagctttctgctctcaaggttacccaattgtaattatgaggtgagtgggtgaagtcatttattcttttatcctacatgtatttctcgagcacgtatcttgttaagagactgttcggggtacagccattcaacagtgaaaaaacgcatatattcttcacctttgcgaagctagtttctagttgataggggtgaagagaaacagatcagaagcaaacaagaaaaatacataagatgttatgtgacaacgtctactgggaaggaacccacaggcagtaagggacttgggagtgtggagatggcccattcagaagcttttaggagcggaatctgagaagttgtcaccttgaagacatcctttacccaccctccaccccctccccactccccactcctgctccttccttcaatcatctttcttcacgtaggaaatgaggactgtgggattctctggctggatcccagcacctagagagggatctgatcaataagaactgctcagtaagcattacctattgctttggttgccttccccttgcagagtgctggcctcttggattgagcttgcatcataggtgttcagtaggagcttgcttagtggatttacaggttgaggttagaacccaccgggattctcttcctggaaagaacaggcttccctctaaggtttcacatagaccccgagtgaggaaagagccctaaattgcttgaaaaattgattgctctttgggcaaaacaagaaaccctcctatggaagggcatcatttgggcatatatcggggtctcagtacaaagatgagtgctcaagaggtcaagatgcttaagcagagaatttcaccagaatgttcgtggtacagagaaacagtcttgttgggagaaggatgacaattgaggccttggaatataagctaaataagcttcaaaggggatacaaaaaagaatcaggcacaaatcctttactacattattttgtacagctcaatttttgcctagaaaatcataccttactttgcatccctattgtgttcctccaccatctattttgtttttttaagcgttatttcatttttatgttcacagaagcttgttgctacaactaaatgagcaaaacagccagtagcaacagaaatgcgttactatctctcctcagaccttgaaagcattttccttaaaggtgaacaatattccacatacaaggaggttttcagcactatgtgctagaaattatactgaatgtttcttaatttttacgtaagtcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacattaatgtaatagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctggggggcatatagagccactcagagccttagaggtacgttcagtgaaatggagccaatcaccatatagtgtagcctattgttcgtctgaccaaaatgcactatgttgcgatagcatggattctacagacccgtgaagcccatttggaccacaagacactctttccatcatgcctgcacacctatccttcactcttcattggctcatgcagacttttgaaagtatttagcaataagcatcctacccccaagaagcttatggtctcatggagaagatggccaagcaacagacaatcccaacatggtgaatgccgctaaaacaaatgcgtacctggatctccgtgagtgctaggaggaaagcaacccaaactcagaaaagtaggagaggtgtcagggaagacattttccagaagatggtttcgtgtctaacaaagccgtgagacgagcaaagaggaggtgaaaggctcagcgttctatggggacatttccttaagtccagtatctctagagttgagtgagggaagctaaaagagaggaaatagaaatgaaaaatgggagttcttgagaggctttacttaccctgcacaagccaaggacaggtctgcgggaagtaagcagatgcacagttaggaaagcccatatcaggagttagtcacgacagagaaagatttgtacactttggaaatcgtaaaagaatgaaaagcccaggtccttatttccctgttttcgtctctgtttttcacgttcctcccggatttcaatttctttctggaatcttagctctcttcgtcatctgctcttgcaggaacactgaactgcaaacgcaaccctacgattcagcgaactacgtcctatcaaggttactgggtacaaatacatttactttcgtgagttctcttgtgactttctgtatcactgcccacagttgctactgtgagacaagcattagaagtctgtgtagattgctgggttcacacacatttacattctttttctcttgtgagctttgacgtggctacacataattgttactgtgaaataaacattagaaaagcctgtggcccgtgaaataaacattagaaaagcctgtggcccgtacggggatcgaacccgcgaccttggcgttattagcaccacgctctgaccaactgagctaaccggccccgccggcggaacggaccctacctctcttgagaagtttaaaggcgaacgttattccaatcaccaaagaaacttttctgaagttcttggagttggaaagaacctacgatctttgctaacttggttacgatcctcggcaaatttcttctaacctggaaatttcagttaaaatacaattctgcggaaggaaagttcaaatgtcacctgcttcagtgtttcacgacaaagggtttcagtgaccacccttttaaacgcaacgccatcaccgtccgccggtactgtggcctgtccctatcactcctttctactttgcttccgtagcttctgagcgacccgtgaagaaattgacggaaaacggaaggaattgccgccagttcctttccacgggccgtcaaggccagtataagtccccacccaggctcctctgctcgtaacttctagcacgattcccactgaattcgcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacatttcgaataactgaataaaggaaatctcaaccaacccccttgccgtattacaggtggtccagctctctgcctagactattgtgctaatgtcctgttccttctcccggcttttgaactagattctcacctctctccaatccatctttcgcagggctggcctgtctttccgcctcacttctgaaattctatccattgcagcctctatgcaaaccgactctggttaatacttcagtcggtatggctcccctcttccgcactttgcactgcgagaaatgcccttccttgaggcagctggaggcctcctcctcctgagagcttaattgtggacacagtcttgagtagaggcgaaaaggaaagaaggctgggagataatgggggaaaagcacacctttggtctggtttgaaagctggcgcccgaaaaggggagcgaaaggacaagaaaaaaaaacacgctccgaaagtgtctgagattgctgcggccataaagcagagcactaaccgcggtactgataagggaggggagcagggctccgccgccgggcctgtgcccatggatctaggtgaggacgggcactccttcctccgcggccaaatgttgcatttcccaagaccaccctggcccgccacgcccccatcctgtgcctataaaaactcccgagaccctagcgggcacggacacaagcggctggacgtgaagaggaacacaccggcgggagaacacagaacacccaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgagctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaaaaacaaaaaaaaacaagtgttctagatttgcagaggaccttttcggagctaagttccagtagctatactgtaagttgatttcttgggcagttctgttggtgaggaaagagggcaaattgagaaatgaacaaacacagaagttgcaaaagccctgtgacttacagcacaggacgagtctacaaaccctgccataccacactaagctcaaattgttttaacaccagcttactcagacccgatgatccaagataagaccaaagccaaacggatccagcaactctgcgcagatcttcatgttccagcagctaagttccactgaataaacctatgattcgcctagtttagaaattctggccgtgcgcggtggctcacgtctgtaatcccagcactttcggaggccgaggcgggcggatcacaaggtcaggagaccgagaccatcctggctaacacggtgaaactccgtctctactaaagatacaaaaaaaattagccgggcgtggtggcgggcgcctgtagtcccagctactcgggaggctgaggcaggagaatggcgtgaactcgggaggcggagcttgcagtgagccgagatcgcgccactgcactctagccgggacgacagagcaagactccgtctcaaaaaaaaaaaaaaaaaaaaaaaaagaaaagaaaagaaaagaaaagaaaaagaaaaagaaattctgtccagtccctcctgagaaggaccttactaaccttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcatttttgtcatatgacactacttgtattttacaggattcacttggtctccatctgacctcctcagagtagactgctctttcccaatcactcctgcaattaccctaggagatgtgtgatcctaaagtaagggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaatataaaggcaagtatctttttcactcagttcaccttggttctaagagtgggtctatataaagaaatggagcatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaattaatcatgttataaacaatatgaacataaaagcaaaaattgcaaggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctaatgcatctacaaaaataagcattataagtaaatgcagctatgtcacagattacaatatacaaaaattaattgtatttctatgtactagcatcaaaaaaatggaaaattaaattaccactttcaataggtttaaaacaaatgaaatatttagagataaacttgtcaatgtgcacaagacttgtacctagaaatctactaaagattgctgagaaaaactcaggaaaacctgaataattggtggtgtttgccatatttacagattgagaaatttaatattatttagataactttttttttctctgagttgatctatagatttagtacaatcccaacaaatatcccagcaggagtttttgttttgttttgtttgtttgtttttacagaaattgacaagcttattctgaaggacttagagtaacctaaataattaggaaaagaaaaacaaagttagaggacttacaccaagtaatttcaagacttactataaagctaaggtaatcaaaataatgtggtattgtctcaaggatacttacccagattgatggaatagaatagatagtccagaaatagaccaatgtatgtggtcaactgatttatgacagaggtaaaatgtttttttaaacaaatggtcccaggcaactgagtatggaaaaaatgattccctacccttaactcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaaaataagatgcttatatggccaataaggcacactaaaagatgttcaacaacattaatcagtacaaaaatgcaaattaaatctatcaaggattaataggtaacaacagatctcaactcccctgaatggagaaacaattagtaacacagatactagataagttacttgaaggatcaatcgataaaaagatacttgggcttatttccaggtttgtgttcttaaaaagtgatgcattcaacagagcatttgaggtaactgctaattagggacggtacttccttctctttcatctaatgggagagtgaaatcagattagaactagtgctttcctaatgagatcttttctctctttctcaggatcccgactcagattgaaaaagcagaggatggtcactgccttccaggtctgaggctgtctcccagaaacttcattcctcgcttcgccttggtagggaagttcccggaggtgtttgaaaagctggaaacttaagtgggacatggaacgatatttgtgtcccggttatcaaaacaggcagaaaagacaaatgcggtgtgggggaattggctcaagcggtagagcgcttgcttagcatgcaagaggtagcaggatcgacgcctgcactctccagcttcttttaatccctaggctaccaatggtatctggtaaatactttcagcggatttaccgctctttatttgactcagtttcatcttgttatgtacattttttttttaaggaaattatacatagcattccatgcaaaagcaaaaaaggaagcgattagtcacaagtgagttttgccaatacaggttttggggcttcagctcgaagttaatacaatgtatttttgtggggaaatcaaactttagccttttgggtacaaaatatgaggaacagcctggaaatagtgtcaggaggcaaaagcaggagacttgaatgtgccaaccttttgcttttattcacattgacaacacatggtcaggtagaggatgaaaacgtgtcttctaccagattatctgagagttggccaggctcccaccttcacttatactccttccttacctctctcctgtgtaggtaagagaggtaaggagagaggtaaggaaggagtataagtgaaggtgggagctagcatattaactctagtggtcggatacactctcactaagaaaagtgacatttattccttctattcatctctctgaaagctcgttctgacaaaaatgtgctcaaaataaatggggacctaggtcttcctctaatttccaagatgaaccaaaacgtaaaaaaatgtatttttgaaattgcaacactatcccctatttaaagaaactacatgaggcgctgtattaacaacacatatgttgactagctcaactggcccaagcagagctcagaatgctggagagagtggtctttggatagatgactccaggaagctcttgtaggtccctgggacgtgcccctctttccatccttctttctttcccatcactcaaatctctctctgacaccatttgacttctcagcattgccctttgttaatcgtaatagaaagacaatgttattgattacatgtttttctattttatcttcttattcataaatgatctcaaaaatgaatgtcataaataataaacatgttgttgaatttttgtcccataggagcagcctctttccttctcaggatgtgcactcctaataaactgggaccgtgaaggagggacctgaagctgccccaaaccacctgcagttccatgaaggccatgcctccacccactaatcactctgaaagtagtgcccctccactcttccccaaccacatttccttttcaggcaaaaacatttctatgggtttgttagaccctagcttctaatcctttcttcagtctttactgatctgaagccactctctcctttgaggcttctaaattatctgtatagcctttctccattcagcaaattttcatcaggcaaaaatcctacttgacgctagttatactcagagtaaaataactatgttcctgtcttaaatgagaattcttcacaggtggaaagcagatttggaatccactacaactccaaggcagtggagctaatgtagcctcccctgggctacaggggaagccttcttctgtgggcccgggaattgaagaactagacaggcataagaaggacaagtgtggtgcccaatggagcaagagaaggggggaggaaggtgacagggaagggaaatggcaggagaagcacctacacagcagacacggtatagcctgcatctgtttttccttttggctgagagatccctgagctctgtggtgacaattttccataatttttcatataaaaaatgaagattataaactatttctaggcattttacctgcattactattaatatgtgtacagcatctaaaatagggtctagacggcaattgcacagtactattacttgctattgttgtggcactttctatgtggatcactggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggcgcgtatggcgtgaagttctggggctgggagaagctgccccactacttccgggcggccttgcctgcagggagcaggtgaggatcacagctctagagcgggctgcaatagctgtgcccgcaagccaggcagttccgggtggtgcttctccaactggaacgtgctctctacttccgagagatgaagaaggcgaaattgagaagtgaggagagaggtctccctcatgacctattttggaaatccgtattcttcacactctcaggctcgtagaactttgcccaaggcagtatctgagaagctccgccctcaatcttgtcctgccagggatttggcggcccaaagtaccggcaggctcctgataaccaggaaaatgggtggggggtggtgtatcctcagtggggaattagctcaggcggtagagcgctcgcttagcatgcgagaggtagcgggatcgacgcccgcattctccagttccttgtccggtttatgtctcttggtttgtatacccgcttctttctcctgttgacaacggcggtgcttcttacctgggagaagatcagaggaacctgccccctcccccgatctcgtgttttactgctccccatgtaagagtcttgttgcccctgcttccatcctcccatgttttccactcctgccacaggtttggcacttctagctactcaggtctcaatgcaaatttcccgtctttagacaagtacagctaaaagtgatgcccacacgatctctcaattcctactacatcttcacaaatatcgtctcctccagaaagtatgtctttaagttactggtttgtttttctctcccctagagtgggagcttcctgagtaccgaaacgctgtctatgtacactgtgttcaactcgcttcatccccatgcgtagagttaaggttctgtaaaatacggttactgccttgaacagataaggaaacagggagatcaaagacagagcaatacttaaaaacattatcctgccacatttctcaaatcttaataatagcattcactaatgtttttggtttttctttgtgctttctccatatccccttattattattattattttacatttggctgaccattttacacttctttttcaaatgaccaatcagattttgcaattttctagttaattcctgtgtttccttcaccattctattttctttttttttttctttttctttttttttttcgggcttcttcttcttcttcttcttcttcttcttcttcttcttcttcttcttcttcttcttcttccttcttatatttaatgcactgatttcttctaatgttttgtaacttgggtattaaaaggtgtaatttaaaatgagaaagcagtttctacagagtccttagaaatatgtcattttaagtccccattttcattatattctaaggagctcgaagatatacttttgattcttttctaaactgtgcattcgagagttaatctcttcttgtttacttttacgttcattctttcaatgttattttctaatttttgtgtatcattttgtttatcaacacataaatatgtacattcacataagtatacgagttatatatacatgtatttatgaatggcagctgaaccacacattagtgctaatattggtgactaaaagttggagaaccagacattatgtacctcataaagcgaagcaatggaaagtgcacaagcccacctatcaaattgtcttgttaaaagatttgaagctgaatctaagtgagcctctacttgtaactaccagtttacaagaaatagagtaggtgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgttaaaaaaaaaaaaacccaggatgtataacacaaagagcaaactgtaatgtaaactgtggacttcagttaacaataatgtattagtaattactggtttaccagttgtaacaagtgtaccatactgatgcaagatgttaataatagggaaaattgtaagagaggtagagtgatggagtttatggaaattctatctattctggtcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaaagttaatattagatcatatttatgatctattaccaatttgttaacaacaagtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggacgtggtagcgcacgcctgtaatcccagctactcgggaggctgaggcaggagaatcgcttgaacctggaaggtggaggttacagtggatcgacatcgcaccactgcactctcaaaaaaaaaaaaaaaaaaaaaaaaagtctttattgaaagtttcaaacttaaaagtgctctcacatataaataaaatcattttctctatatacatggtttttgcaagtgtacatgtctagacaccctaggaatggtggtgccgtggtgtgaacgtggagcctggaatggccagccccaaaacctcctcctcatcaactgttgactcgtcaacagtcagtcagtaatcaaaacttccttaaaatacaaagagccgcagaacattccgggatatctgtgctacttaatctggcagttcctactgtgtcttgcccccggtgtgacgtgctctcttccatgaaattaataactgcaaactgtaatgggaacaatgcaattgattgtctccgcactcttgcccaaagcgttctctgagatgtttggtagttatttgggtccttacttgaccttcgtggccttaaaacaaagggaacatggcatttgtgaatctgaaagaattgtgataattttctcatttcctcctggctgtgtgcatcaccctgagtttgcggagggatcagccctttttcagagccccctcacgtcctgagtatcatcctcagaatgtggggcttgggctcaatttgaagagggtgtgagggagagccaaaatgcagggattgtcccacagtgcagtcctgctttgtaaaccccttcctctgactagcttgattttagtctctgagaatggatggggtgggatggcttttcagtactttctgctgagacatttttgtatattcatttctctctcaaggagcctctgtaacaaaagagaaaaaactgtctcgggttctgtgtgtggcacatgagtttgaaggatttctgagactattgttcaggactggcgttacagatgaaatatagattcaggaccagtgacggtgggatccttggcaggcggacataacgcctcgttaaggacagactgcccaccactctctttctttctttctctctttccgaaatcattttctataaattccactgggtatcagaaccttccttaggctgactggcgcttcgcagtctcctctccaagcccggatctattccccaaaattctctcgttcatgcttctagcttctcttcttagcttctctaggttcgcgtcatcggctttccttgtttcccaggttgaatccccagttccaagcggctcctgtaacagggagtgggagcccaccctcccactcgccgtgtagcactctgcatctctgagaagaaagtgaccaccccagcccagcacagattttcttcgtctttgagcacctgctcggagttcccgcccctcgtcgctccttggttttccctcattgcctacatagagtctgttggatgtcggtcaaggtatccccagcccctgccgtgggaaccgtttggggaaaaacagacctgatttatttatacttcaaagatgcccaatgattccctgtcgtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaagtgagcgggttacaaattccgctaaccccagcccgccaccccgctattggctatttgaggcatgtgggggatttttccggactagaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaaggtaagcgttcacttgcaaaagctgccctctctgaggctcgaactcaggaccttcagattatgagactgacgcgctgcccgctgcgctaagagggcgacgaagtgcatcaacgcgccagcttccacaggaatttcctaatttctttccccaggcgggttattttgggacttcagttttcttcgcccaaggtcgctagttttccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctctcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaataccctattaaagattttattcccgtaatttcatttagtccaatttatttatttatttatttgccataaatctatacatcattatccccatcttactgatgaaactgaggctcagcagaactaaatccacagctgataaggggcaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacctgccatgtacccggcatttatgctctagatttccaaggcatccttggccctttatccctcacatccctacaaacaccttaaatcattagttctcgaagtgcggtgcccagacccaccacataattctcgaggacacattccatttcaggtactgtgctacccgaaggctttgaggattcagaggaaattgagccatccctgacctcaggagctgacaggacaaactgtcctatctggtccggttcctatactctcaaacttccggattcttataaatgcatcttcctaaatattttattttgatactgtaactcccattctgcactagtttgctagggctgccataataaatatcatagactgagtgccttaaccaacagaaaattttctcagttctggaggctagaagggttgttagctttggtttctcctgaggcctctctccttggctcgcagatggtcacttaccttcttgctatattctcccacggtctctctctctacacatgtttccatcttttcttataagaactcctattgggagttagggtttcgacatgaatttgatgacaggtggggcgggacaaaattccaccatgacaggctcaaagttgtttacattttcaccctcatatttgcagtagactttgttactggaaaacactacttgcttttttttttttttaacacgtattttaaagccccttaattaaacagaccatatacctttccttatctaggaattcccattccagtgcctggtccacacatccattatttctcctcatctccattcctcaaggcccattcttgattctttcattcttatttgaaagaatgtagcatggaggaatgtagcatactagtttttccctcggaattgcatgactcattgtcatgcaaattacgcagtctcaggtgttccttttagcaacacaaagtagactaaggtgtgtacatttttgtacttgtcaaatgtggttagaataccaaatgaggtactgcctcacagatccctgagatgtcattacttggcataacaaaatcataatatagatatcataataatgcataagcagacaggaaaaaaccataataataacaaaactcattaagggatagccacgtaagtttatcagttagttctctctaaactctgtaatatgaatgtggccaatctctgggatttaataatacaaaaaacatgttttggtctcccagtgtcattttaatcttattcagtaggatatattctttccctatctccatatgaagacatacacagttttatgcctcatcccaggcaatacagtctcagtctcaaagttaagatgctgagctccatgtaacactctaaaatttaaacttgacataaagatcagatctcttcctttacctactgggcctgttgagtcagctaaaactatttggatagttttctaaggaaaatgtttcatctctcttttcttaccctaacattctaccatttgttaaccactgttctgagacttccgtgtttcaatcgtggtggaagatgagttaaagccagggaggggtggtggggagaataataaagttcttacttttaaatggtgttgtcattagccagtgtcatgctttccattcagctgtttgaatacgaataatttttttaatacgatccatgattgtggattctcgtgtgcatttcccttgatgatgatgtactctcctgtacccccttctttatgactgcttttccagccactgcaaaactcaaagcttccttttgcttctttttccttagttacgttcatccttccacatagcccactgggactggctcaaagttgacctcatgctagtgctccctctctcctgattcccacacctgtcttgtgggaaaggcctacatctggttgtccctgaaaagccctgggactacaggccaatcccaatatagaaggaacttcaggcagtcaatctgcccatttctcccctttacatttctcatgcatctaactaccgtatctcccatattttggtgccagtgattgaacttgttggcacctgtattagtccattgtcacactgctataaagaactactggagactgggtaatttatgaagaaaagaggtttcattgacccacagtgccacaggctgtataggaagcatggctgggaggcctcaagaaacttacaatcatggcggaaggcgaaggagaagcaagcatgccttaccatggcagagtcggagagaaagagcaaaggggaaagtgttacacacttttcaacaaccagatctcaggagaactcactcattgtcatgagaacagcatgagggaaatctgtctggaacaggtttgtgaacccattgaggtgttcatccagtgctgtttcagagaaatctctatttcaatctattcctatacattagttactgaaaaacaacagacaatcacaaaaacaagttgacctttttgtgatccttgagcccagttgcgaagggccctcgtgaccgggcctcatgccaaacaactcgttacaaaaagagctagggttccagactgggctgaagcttcatgagacttctcctcgtctgtgcgcagacagctggccaactctggagcccaggctgttgcttcccggtctgttggtgaatcctccatagtctggtgagtgtacatatatatgtatatacatatatatatatatatatatatatatatatatgtctttttccttcccattgcaatttgcttattatatcagtctgcttattatttcatttgcttattatatctgcattgccatttacgtgggataaaggttgtttacccttaaaggtgttgtgtgggtgtcttttcttctccctttacatgtcttccacacagaacatgtacacatgtatctacaggtgcatgtgtgtatgtagaagtgattgcacctgtgtttatgtatacatgtctgtgtacaccacatgcatgtgtaaatgtatgtgggtacacgtgcatgcatgtgtatgcatacatgcatgtacacatgcacaaaggtatctacacatacatgtgtatacatgcatgcatgcatgtttatgtatacatgcatgtacaccgtatgtatgtgtgtatgcatgtgtgtattttcagacgcatatgcatatgcatacatgcatgtacttgcatgtgcacacgtagctgcacattcacgtgtgtatgtatacatgtatgtacacgtgtgtgcatgtgtgagtgtgtaaagatatgtaaacatgtatgtgcaaatgcatgtgggtgtgtgtgcatggatgtaggtgtatccatgtattgtgtacacagtatgcatgcatgtatgtgtgtagatatatgtgcagatagacatgtgctcacacgtctgcatgtatgtgtgtacatgtgtatgtgtttacccacgtacgtgtgtatgcacgtgtgtacgcatgcatgtacatgcgtatgcatgtgtgtatgcatgcatgcacatgcgtatgcatgtgtgtatgcatgcatgcacacatgtatgcataaatgtatgcattgtgcacatgtatgcacatgtttgtatgaatgatgtatatatacatacacgtatacaccatgtataccagcctacaaatgcatctgtgcacacacatgtgaaggcgtgtgtatgcctgaatacaagtgtccatacatacgtgtgcatatccacacatacatgtgtacaacacgcatgtgtgcacacatgcatgtgcacacacaaaaattcgtgtgcaaacacatgcatgcatgacatatatgtgtacatggatatgtgggtatacatgcatgtgcatacacacgtgcacgtgcatgcacacatgcacacataatacatgtatatatacatacatgtttgcgtgaaaagcacgatgcatacatgcacacaaacataaatgtgcatacgcacgtacttgtgcatacaaatgcacatgtgtacccatacatgcattcagacgtttgtgcaatgtatacatacacctataagtacatacacacatatacactcatacatgtttgcacacacgcatacgtacacacatgcacgtgtacaaatacatgtgtgcgtgtgcatgcatttgtgcatattcattgattgtgtgcacaatatgtatgtgtgcatgtatgtgtgtatacgtgtatgtgtagatgcatacgtgtatgttaacatgcatgtacactcatgtaaacatgcatcaacacatttatacacgtatttatttgtgtatcaggtttgtatacacgtacctaaacatgcatgcgagcattcgtgcatgtatgtacacgagaatgcatatgtgtatgcatacgtgtatgtacacatataagcacaggcatctacacgtgtgcgtgcgcacctatgtgcacacttatgtatacatgtatgtgcacgtgcataaatgaattaagaaagaaacaattcacccaaacaaggaggaaaagatgaacatctcaagtacctatgagcatttttacatgcagaccccttactgacattggccaagacagatgacaagagatcatcaaggagagagttcattagaaaaagatactgctaacattagagaaacatagcatcaatcacccatagcatggatgctgttgagcttccacctgaaaaacaaacaacaacaacaacaaacctggcgggtagaaataggaacaggtttagcattacatccctccctccttttcctgggacctgcattgggccccataagcttggcatgaacctaagtgaataagacaccaaaggactgaagtttaccactaccttcagaattaggactcagagccaggaatttctttagactacataaccagtctatgcatatgtgaggatttggactgtagttcacactggctgcgcttccttatggaaacagtgactacaagatggaggatattaatgaaagatagcacacatctatactaaatgtcataacagcaaaaaccataagatagttactgacaatgagtcatgcaattccgagggaaaaactagtatgctacattcctccatgctacattctttcaaataagaatgaaagaatcaagaatgggccttgaagaatgaagatgaggagaaataatgggtgtgtggaccacgcaatggagtgggaattcctagataaggaaaggtatatggtctgtttaattaagggactctaaaatacttgttaaaaaaaacaaaaaaaacagcaagtagtgctttccagtaacaaagtctactgcaaatttctttctgtacatgggaaataaggactgtgggattctttgggtggatcccagcacctagagttggatctgatcaaaaagaagtgctcagtaaacatttacctactgctttggttgccttccccctgtggagtgctggcctccaggattgagcttgcatcataggtgttcagtaggaacttgcttagtggatttacaggttgaggttagaacccatcaggattcttttcctggaaagaacaggcatgtgttcttcccttccctctaagttttcacatagacactgggtgaggaaagagccctaaattgcttgaaaaattgattgctctttgagcaaagcaagaaaccctcctgtggaagggcatcatttgggcatatatcggggtctcagtacgaagatgagtgctcaagacgtcaagatgcttaagcagagaatctgaccagaatgttcgtggtacagagaaacagttttgttgggagaaggatgacaattgaggctttcgaatataagctaaataagcttcaaagggtatacaaaaaagaatcaggtacaaatcctttactacattcttttgtacaaatcaatttttgtctagaaaatcataccttactatgcatccctattgtgttcctccaccatctattttgtttttttaagcgttatttcattttcatgttcacagaagcttgttgctacaactacatgagcaaaacagccagtagcaacagaaatgcattaatatctctcctcagacctttaaagcattttccttaaaggtgaacaatattccgcatacaaggactttttcaggactatgtgccagaaattatactgaatgtttcttaattttcacgtaaatcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacatttatgtagtagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctgggggcatatagagccactcagagccttagaggtaccctcagcgaaatggaaccaatcaccatatagtgtagcctattgttcatctgaccaaaatgcactatgttgcgatagcatggattctacagacccgtgaagcccatttggaccacaagacactctttccatcatgcctgcacacatatccctcactcttcattgattcatgcagacttttaaaagtatttagcaataagcatcctacccccaagaagcttatgatctcatggagaagatggccaagcaacagacaatcccgacatggtgaatgccgctaaaacaaatgcttacctggatctccgtgagtgctaggaggaaagcaacccaaactcagaaaagtaggagaggtgtcagggaagacattttccagaagatggtttcgtgtctaacaaagccgtgagacgagcaaaggggaggtgaaaggctcagcgttctatgggacatttccttaattccagtatctctcgagttgagtgtgggaagctaaaagggaggaaatagaaatgaaaaatgggagttcttgagaggctttacttaccctgcacaagccaaggacaggtctgcgggaagtaagcagatgcagttaggaaagcccatatcaggagttagtcacgacagagaaagatttgtacactttggaaatcataaaaggatgaaaagcccaggtccttatttccgtgttttcgcctgtttttcacgttcctcccggatttcaatttctttctggaatctcacctctcctcatcatctgctcttgcaggaacactaaactggaaacgcaaccctacgattcagcgaactatgtcccatcaagattactgggtacaaatacatttactttcgtgttctcttgtgactgtctgtatcactgcacacgtttgttactgtgaaacaagcattaaaagtctgtgtagattactgagtacatatgcatttctttttttttcttttttttttattatactttaagttttagggtacatgtgcacattgtgcaggttggttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtaattctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatggtatctcatagtggttttgatttccatttctctgatggccagtgatgatgagcattttttcatgtgttttttggctgcataaatgtcttcttttgagaagtgtctgttcatgtccttcgcccactttttgatggggttgtttgtttttttattgtaaatttgtttgagttcattgtagattctggatattagccctttgtcagatgagtaggttgcgaaaattttctcccattttgtaggttgcctgttcactgtgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggttttcatggttttaggtctaacgtttaaatctttaatccatcttgaattgatttttgtataaggtgtaaggaagggatccagtttcagctttctccatatggctagccagttttcccagcaccatttattaaatttcttttcttgttctcccgtgacttttgatatcactgcacacaactgttactgtaagatgaacattaaaaagtcacgtctggccagtacggggatcgaacccgcgaccttagcgttattagcaccacgctctaaccaactgagctaaccggccccgcttactaaaaccccccctaaacctcttgagaagtttaaaggcgaacgttatttcaatcaccaaagaaacttttctgaacttctcggaactggaaagaacctgcgatctttgctaacttgtttatgatcctcggcaaatttctccgaaccctgacatttcaattaaaatacaattctgaggaaggaaagttcaaatgtcacctgcttcactgtttcatgacaaggggtttcagtgaccacccttttaaacgcaacgccatcaccttccgccggtactttggcctgcccttctcactcctttctactttgcttccgtagcttctgagcaacccgtgaagaaattgacggaaaacggaaggaattaccgccagtttctttccacgggccgtcaaggccaatataagtccccacccaggctcctctgctcgtaacttccagcacgattcccactgtattagcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacgtttcgaataattaaataaaagaagtctcaaccaacccccttgctgtattacagatggtccagctctctgcctagactattgtgctaatgtcctgttccttctcccggcttttgaactagattctcacctctctccaatccatctttcgcagggctggcctgtctttccgcctcacttctgaaattctatccattgccgcctctgtgcaaaccgactctggttaatacttcagtcggtatggctcccctcttccgcactttgcactgcgagaaatgcccttctttgaggcagctggaggcctcctcctcctgagagcttaattgtggacacagccttgagtagaggcgaaaaggaaagaaggctgggagacaatcggggaaaaacacacacctttggtctggtttgaaagctggcgcccgaaaaggaacaagaaaaaaaacacgcttcggaagtgtctgagattgctgcggccataaagcagagcactaaccctggtactgatacgggaggggagcaagactccacccccgggcctgtgcccatgaacctaggtgaggaggggcacttcttcctccgcgcccaaatgttgcatttcccaagaccaccctggcccgccacgcccccatcctgtgcctataaaaacccccgagaccctagcgggcacagacacaagcggttggacatgaagaggaacacaccggcgggagaacacagaacacccaccctctctttagtcaccctggaggcctcggagaaggcggtttcagtgatccgtgaagagaccctgagtcttttacatcccggagaatgacaagagagtacctgggcgacgtaactttctgggttttccggagatgcggttttctacacgccaggggccaagcctgagaaataggtggacggcaaggacaggagctctctccgcgccacaaacgcccctgctcacacctgggttccttgattttcctgcctatataaccgagccacccatggccgggctccgagctctcattctgcggactgggacaaaggggttaactgtgatgtgctttgtataaccccaggattctgcacttgcccaagggcgaggtgcaaatccaaaatcacgcacgactgaacgccgagatcagctgagtcctgagtgcctcacgacacaaaatccgtatgatttttaaaagcgctgtatttgtgctgacaatgcatgtcagatcccatctgtctttagctcaatgtgtgacgttagacacgtcgttttgctcctcaactttcttatttggaaaaaaaaaaacgagtgttctagatttgcagagggccttttcagagctaagttccagtagctatactgtaagttgaactcgggcagtcctgttggtgaggaaaaaggacaaattgagaaatgaacaaacacagaagttgcaaaagccctgtgacttacagcacaggacaagtctacaaaccctgccatgccacactaagctcaagttgttttaacatcagtttactcagacccgatgatccaaggtaagaccaaagccaaacggatccagcaactgggcagatcttcatgttccagcagctaagttccacggaataaacctatgattcgcctagtttagaaattgtctagtccctcctcagaaggaccttactaactttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcgtttttgtcatatgacattacttgtattttacaggattcacttggtctccatctgacctcctcagagtagactgctctttcccaatcactcctgcaattaccctaggagatatgtgatcctaaagtaacggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaacataaaggcaagtatctttttcactcagttcaccttggttctaagagtgggtctatataaagaaatggaacatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaagtaatcatgttataaacaatatgaacataaaagcaaaaattacatggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctagtgtatccacaaaaataagcattataagtaaatgcagctatgtcacagattacagtatacaaaaattaattgtatttctatgtactagcatcaaaaaaatggaaaattaaattaccactttcaataggtttaaaacaaatgaaatatttagagataaacttgtcagtgtgcacaggacttgtacctaggaatctacaaaagatggctgagaaaaactcaggaaagcttgactaattggtgttgtttgacatatttacagattgaaaaaggtaatattattaagatatcatttttttccctctgagttgatctatagatttactacaatcccaacaaatatcccagcaggagatttttgttttgtttgttttgttttcttttctttttgtttgtttgtttttacagaaattgacaagcttattctgtaggacctagagtaacctaaataattaggaaaagaaaaacaaagttagaggacttacaccaggtgatgtcaagacttattataaagctaaggtaatcaaaataatgtggtattgtctcaaggatacttacccagattgacggaatagaacagatagtccagaaacagaccaacgtatgtggtcaactgatttatgacagaggtaaaatgtttttttaaacaaatggtcccaggcaactgagtatggaaaaaatgattccctacccttacctcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaatataagatgcttatatggccaataggcacactaaaagatgttcaacaacattaatcagtacaaaaatgcaaattaaatctatcaaggattaataggtaacaacagatctcaactcccctgaatggagaaacaattagtaacacagatattagataaagataagttacttgaaggatcaatcagtgaaaagatacttgggcttatttccaggtttgtgttcttaaaaagtgatgcattcaacagagcatttgaggtaactgctaattagggacggtacttccttctctttcatgtaatgggagagtgaaatcagattagaactagtgctttcctaatgagatcttttctctctttctcaggatcaggactcagattgaaaaagcagaggatggtcactgccttccaggtctgaggctgtctcccagaagcttcactcctggcttcgccttggtagggaagtttccggaggtgttcgaaaacctggaaacttaagtgggacataagacgatatttgtgtcccggttataaaaattggcagaaaagacaagtgtagtgtgggggattagctcaagcggtagggtgcctgcttagcatgcaagaggtagcaggatcgacgcctgcattctccagcttcttttaatccctaggctaccaatggtatctggcctagatgacagttgcacagtactcgttattgttgtggcagtatctatgaggattattggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggctatgccgtgaagctctggggctgggagaagctgccccaccacttccgggcggcggtggcggcaaggagcaggtgacgatcacaactctagagcgtgctggaatagctgtgcccccaagccaggcagttccgggtggtgcttctccatccagaatgtgctctctgattccgagagatgaagaaggcgaaattgggaagtgaggagagaggtctccctcatgaccttctttggaaatccctattcttcgcactggcaggctcatagaactttgctgaaggcagtatctgagaagctcggccctcaatctggtcctgccaggggtttggcgacacaaagcaccggcatgctcctaataaccaggaaaatgggtggggtgaaaagtttctcctctggggaattagctcaggcggtggagcgctcgcttagctatgcgagaggtagcgagatcgacgcccgcattctccagtttcttgtctggtttatgtctcttagtttgtattccccgttgtttctcctgttgatgacatcggtgcctcttacctgggagaagatcagaggaaactgccgcctccctagagcccgtgttttattgatccccgtgtaagagtcttgttgcccctgcttccatccttccttcttttccactcctgccacaggtttggcacttctaggtactcaggtgtcagtgcaaatttcccgtctttagacaagtacagctaaaagtgatgcccacacgatctctcagttcctattacatcttcacaaatatcgtctcctccggaaagtatgtctttgaattattggtttgtttttctctcccctagaatgggagcttcctgagtaccgaaacactgtctatgtagactgtgtttaactcacttcatcaccatgtgtagagttaaggttctataaaatacggttactgccttgaacagatgaggtgagtagtataaggaaacggagatca

SEQ ID NO: 175 - DNA, 67337 bp, Homo sapiens
acccaccaattaaataggtatgtcccacaatacacactgaaagatttctataccatcactgttctttctgtcctgtgtgccatcttcatcttcatttctcagctatatctatttttatttcttctctttaatatggccttgccccttgccacctttctgtaatacatttctggttttttgctattcacttatatggtatggttatgtgactacatatgaaatacataaacagggattgaaatttaagttgttataagtttaaaatagccggttataattatataattataaaatgttttaggtaaacctcacgataaccacgagacaaaaacctatagtaaatccacaaaagataaagagaaacaaataacagcatactaccacagaaaataattgaatcaccaatcaaaacagcaagagaggaagaaaggaacaaaaaaccctaaaaaacaaccagaaaatacttaacaaaatgtcaatactatgtccttaactgccaataattgccgtcatgtaaatggattaaattcttcaatacaaagatatagaatggctaactggattattaaaaatatatcccaaaaaagacccaactgtatgctgcctacaagaaattcacctcacctttaaggacacacagattgaaagtgaagagatgggaaaagacattctgtgcaaatggaaatgaaaagagagcagatatacttatatcagataaagtagacttaaagtcaaaaattgtgaaaagagagaaaggggtctttatattatgataaaaaggtcaattcatcaacaggatataacaattatcaatttatatgcacccaacattagagcacctaaatatagaaagcaaatattcatagatctaaagaaagagatagactgcaatagaataatatgaggggacttcagtcccccactttcaactatgaacagatcatccagagagaaaatcaatagaaaatattggacttgatatatacgttagactaaatggacctaacagacatatacagaatattccacccaacaacagtagaatgtcacttctatttaacatggtgctggaagtcctagccagaatacacattctggtcaggtgcacatgaaacactctccaggacaggccatagataaggccacaacatgagtcttaacaaatttgagaagactgaaatcatatcaagtatcctttctggccacaatggcatgaaacaagaaatcaacaacaggaggaatttttgaaaattcacaactatgtggaaattaaacaacatgctcctgaacaaccaatgggtcaaagaagaaatcataagggaaattgaaaaattactttgggacaaatgaaaatggaaatacaatataccaaaacttacaggatacaagagcagttctaagagagttttcatcaaaaaagatgaaagatcacaaatagactacctagcatccattacacctcaaggactggaaaaacaatcaactaagctagttacaaagttagtaggaagacggaaatgataaagatcagaagaagtaaacagaagatagaaaaaataaagagaccaaccaaactaagaattttttttaaaggtaaataaaatttacaaacctttagctagactgattaagaaaaaaaatgcaaagactcaaataaaatcagaaatgtaatcagaaatgaattgaagaggtaacgactgttaccacagaaatacaaaggattatttaaaaactactatgaacaattatatgccaacaaattggataacctaaaaactggataaattcctagacacatgcaacttgcaagacagaatcagaaactctgaacagagcaaaaacaagtaaggagattaaatcagtgataaatctaccatcagagaaaagcctaggacctgacaacttcactgctgaatttgatgaaacatttaaagaggaaataccagttcttctcgatctctttcaaaaaactgaagtagaggaaatactcccaaacacatttcacaaggccagcattaccgtgaacccattgcctgaggagagcactacaaagaaaaaaaaattacaaaccaatatccctgatgaacatgtatgcaaatatactcaacaaaatactagcgaattgaattcaacagcacatttaaacaattatttaccatgatcaagcaggatttatcacagggatacaaagatggttcaacttatacaaatctgtaaatgtgtgatccaccgtattaacagaatgaaagacaaaaaccatctcatcatctcaatagatgcagagaaagcatttgacaaaatttaacattccttcatgattaaaaactctcaaaaattaggtatagaaggaatgtaccttaacacaatagaggcctttataggacaaacccacatctaacatcatactcagtggggaaaaaaattgaaagctttccttttaagatcaggaataagacaaggatatccactcttgccacttctatttaacatagtactggaagtcctagccagagcaattaggcaagagaaagaaataaaagacatccaaattagaaaggaagaagttaaattgtccctgtttgtagatgacataatcctatatatagaaaaccctaaaaaactcaccaaaaatcaaaactgttagaaataaaaaacaatttcagtacagttgcagaatacaaaacaacatacaaaaatcaacatacaaaagctagcatttctatacactaatggcaacctaaccaaaataaaaaattttaaagatcccatttacagtagctacaaaaaatacttagaaataaatttaaccaaggaggtgaaaggtctgtatactgaaaactattaaacactgatgaaagaaattgaggaagacacaaatggaaagatatcctgtgtttatagattggaagaattaatattattaaaacatccatacccccccaaagtgatctacagattcagcgcaatctctatcaaaatcccaatgacatttttcacagaaatagaaaaaaaaaacccttaaaattcatatggaagcacaaaaggccccaaatagccaaagcaatcttgagcaaaaacaaaactggaggcatcatactacctgactttaaaaatatactacaaatatatagcaatcaaaacagcatagtactggtggaaaaacagacatataaaccagtggaacagaatagagagggcagaaataaatccacacatttatagtcaattaatttttgacagacgtgcctagacacataatgaggaaaggatagtctcttcaataaatggtgttgggacaactggatatctacatgcagaaaaatgataggaggcccttatctcataccacatacaaaaatcaactaaaaattgattgaagacaaacataagatgtgagactctaaaacttctagaagaaaacatatggggaatgctccataacattggtctgtgcaatgattttttggatatgaacccccccaaaagcaaaaagacaaaaatagataaataagattacatgaaactaaagaacttctgcacagccccccccaaaaaaaatcaacagtgaagagacaaccgatagattgggagaaaatatttgcaaaccatacttctgtaagtggttgatataaaaaatacatcaggaactcaactcaatagcaagaaaacaaataacccaattaaaacatggagaaaggaccttaatagacatttctcaaaggaagacacattgccaacaggcatatgaaaacttgcttaatgtcatttatcatcaggcacatgcaaatcaaaaccacacctgttaaaatggctgctatcaaaaaggcaaaagataacaggtgttggcaagaatgtggagaaaagagaatccttgtacgttgttggtaggaatgtaaattagtgcagctgttttgtacagcagttcctcaaaaaactaaaaagagcactatcatatgatccagcaatcccacttctgggtatatgttcaaaaatcgggctattgaagagatacctgcactctcatgttcattgcagaattactactaaagtagctgaatcaacctaagcgtctatcagcagatgaatggataaagaaaatattacaactgcacaatgaaatactattcagtcttttaaaaaacagaaatcctgtcattttcgatgtcgatgaacctggagggcattgtgttaagtgaaataagccaggcgcagaaagacaaatactgcacgatctcacttaaatgtgaactctaataaacgtcaaactcatcaaagcagagagtagaatggtagttaccaggggctaggggaggagatgggaggtaggaatggaattagagagatgtttgtcaaaggacacaaaatttcagttaaacaggaggaataaggtcagatctactgtgccgtatggtgactacagttaataataagtgtattctgtactttatagttgctaaaagagtagacttaagtgttcccatcacacacacacactaagtaatagatacgttaattagctcgagttaaccattccacaatgtatgcatatatgaaaacatcatgttgtacatcataaatatatacattttgtacttgtcaactaaaaaaattgtaaaaaccagtatttaatgctcatctcaaaatataaaaagcctgtgatgcaaagggtttctatggtgtagtcgttaccacgctggcctaacacatggaaggtcctctatttgaaactcaacggaaacaacaggtttctctggtctcccagaatctgaccgggagtggccgcttcttcccgggagtccagagctgcaaggaacaagtgataatcccgcctcttttaaaagaaagatcgtcatcctgggatagctgtgccaaattagcaggccgctctgggcgggcgctccccagctgggacgtgctcgcttctctccctgaaaatctggaacgtgaaatcttacagcaccagacttttccagtgtccactttctcctggttacgttttcccctctccctcgcagaggaatagccatcatgcccttgcccttggccatttttgagtagactcgccttaggtcgagtcctggttccccactaataatcgagacatttcctttgttccgagacgcaagaaatggtgggtagtcgcgcacatctactcctgaataaaggaaagggcagaaagttttgcggtaggtgacgagtgagcgcaagtggtagagtactcgcttagcatgtgagaggtagtgggatcgatgttgtcacttggggccgcatgtccatacagtacaacgtggagaacggcttcattagtcacctgtcgaagaaaacgaggaagtaccagccatcttgaatgcttcactggtaaaagacctatgggcataaagaaacagtgctaataatagcccctaaaacgttcagtggacagtacccattttctaagttgttttctctttattcagaggaaagaggagatcccaagagggtgggatatacccaattgttccttttctctccttcctgcagcttgacccaaaatgccaaaatgcagcacagctctggaaaatgcagggcagagcaggatgagtaaaaccccagctttctttctggtcagggcgctgtaaagtggagttccgagtcaccgggaagtcctgctgagagtgtggaaagcaaacccacaagtggtttgtcaactcaccgagtgcacccctgagttgcgaatatgtagctgtaaagagcaaaaccaaatacagaaagcttattttttcccaatttaaaaacatgttttgtgattctactttagacatcttgaataggcaaattcatgtagacagaaagaatagaggttgttggggagagggaaatgtggagttattgtttaatgggtacagagttgctgtttgggatgctgagaaacttctggaaatgggtagtggtgatagttgctcacattgtaaatgtacgtaatgccactaaattgaacacttagaattttaaatgtaaaatgggttaagtatattttaccacaataagaaaacacaaactcttgttcattctgtaatttagcacatagtctcatcatctgtttttctccacaccagctcatctgttcatccttctattcatttgacaaatacttagaaatgtctagatttattgttccattcatcagacattaattcaggatctcttgtgtgccacagtgtcaagacttctccctcaaatgtttacaccaatgtcttgacaaataccatagatctttcctgcacagcctctccagaatgtttttcttacctttcactcatgtttctcttgcccattctaccacgtttatggaggacgtagtctgcaccacaaagtataatgggcactggagctacggaaagactcatgctgttcacttcagaagctgacggaataaatgtgaataaacctcaattctttaatctatttataacttctttccatttctcttcaattacagtcttcctgttcccaagctctttgacatccaacactaaacacctttttcttaaatgttaatttggttatgtaagctgtctgcaattttttcaagggttcttaagtctcaatgttttcccaatcattatctccatgtgcacaggcatttcaatcactacttcctttcattttataaacaggcacacacacaagcaggcacatatgcacttgtgcactacacatcccaagtgaacaggcatgtttcctcacacaggaattcctacatctatgcctgttccttcaaactcatgtgcattcttcctcatctgcatccttcaaggttcatatttatccctttactacaaactgatcttttaatccccatggttcttgtctgtaatacttttgtgatttttgctgttttcttatgtgatgtgaatatgtgagttctatatgatgtaacttaaaaagacttgaatataagtatgtgtatatatatatatatataaatctaacataaatatatcctatatatcttagaaatctaagatatatacataccttgaatatcttagatatatctatcttagatttaggaagtctgagggtttcctcagtgtagtgtagaggttatctcactcacttgcctaacacgagatgaggccctcagatagaaagacagatgttatataattataaagcgtctattcaccgaagggacacaactgtcctaaatatgtctgtttctggccacagagcttcaaaacttatgaacaaaatggataaaccagaaagaaaatagaaaaatccaattacagttgcagacgttaacactcctctctcagtaattgatagattcaggagaaaacaaatcagcaaacattttagagaacagaacaacaccatccaccaatggatctaatagactttataaagcaaaatcacaatttatgtagaaaggcgagccaaaaaaatcaaagaaaagcaagatcatattataagtaggaaatcacgaatggtcagagtgcagaaaagtgacattattgaaactgatatttctgaaacagttacttaaatagcaggaagaccgataacggcgaatctgtaagtgaatctttccttgtccatatgtatcctgctttttcttgaggtctgggctggccaaatgtctcctgaaattcctgggcctactacagtgtctggcacagagcatctctccagcaaatatgtactgaatgagtagaaaggaactgacggattcagaagagacctgcaagaataatgttcagtatttggcaaatcactgaatgtggtgtttgaaggaggacaatgagtcaaagttgacttggaaatctaggcccaggaggaggttgagaattagatatgtggtatatgaatgaatggactactgtggagaaaaacaggcagagagataatgagcaggagcagagaaaagactcaccttttggaatctaaaataaatgtgcttgtcagttcaggctttgccacctagcatctctggcaccttagaaacaataattatctgagcctccagtacatctagaaagtgcacattaggatacatcgttttgttagcgaaattcaactggactacgtaaacgcaagaaatctcgtagtatacttaatagcacacaagaaaaaacaaaggggtaaaaaacaaagagggtgccattataagtattttgtgtttttttttgtagcggcaatgtcttcagtcatgtagatgcaagtggagatatgaaggaagacagtagtatgatcaagagacaggtttgatggctatttcttcattcatttatccaggtggtcagtgaactatcatgaactgagaacctcctgtctcttttcaacagaggagactatggaaagtgtaagagtgactaaggtttctgagggaaggaaaagggaaaaagagcagcaaaagacaggtacaattgatcctggtaacgcagaacccagacggtcctatgaaatactggaaaggcgtagactcctctggtcgtgggtatggaatcttcctagtgcagcgttgattgatacagagtaattttcaagtaggattgattgtagtttttgaaagctgaaaccgtaacgtaggtgggaaatacacttcgacaaaatggatgttgcccgagctcaacagcaagccctcttagcgcagctggcagcgcgtcagtctcataatctgaaggtcctgagttcaagcctcagagagggcatcacttctgccaaagaagttggatacactaaatatcggaacgcaacgcaaatgctatagcagataaggatttgaagactgacccaatatttgtagaaaatggaaatataatttaggttttcttgttttttcgactttccagtggtttgagtaaaatgagtggtgaaaacagaagagtagattacaccagaaactacaagctatgtcatataattggtctttctagctgacacaggaagcaggggaaatttctcttccaacttcccgctctcagggtcacctcacactaattattgggtggatgggtgaagtcatttattcttttaatcatccaacaaatatttcttgaacacatatcttgttaagagactggggtcaagagtgaatacaacgcaaacattcctaccactgtgaaactacatcctacttgggaggagtggggtgaaagtgtattcagcacaaatattcctactattgcgaaactacatcatacttgggaggagtggggagaaacagacaggaaacaatcaaaaatatgtaagaagtgatttgacgatgtctactgtgagggaatcgctaggcagtaaagggtttgggaatgtggaggtggcacattcagctttcaggaggacaatcagggactctgtcaccttgacaactttagccttgccttcttctagccatcttgctggaacacttgtgcccgtgtttttctaacactgtcataagagtacttttacctatcaaggcaactgggggttaggagagctttttgcccagaaggctagttggcttccttggaaaactgatgatacatgaggactggggttgtcaatccctcacatgtttcttcatatgaaaaatgaggactgtgggattctctggctggatctcagcacctagagatggatctgggcaataggaactgctcagtattagctaccgctttggttgccttctccttgtggaaagctggcctctcacactgaatttgtatcataggcactcatgagggtcttgactacatcaatatctgatgggagactttagggcagttctgttgtcgtagctgatttgctcatttggtagctagcatccagcttcttgtgaacattaaaataaaataaaataaaataataaaataaaataaaataaaatagattatggaggaatagaatacagatacatactaaggcataattttccagacaaaatggatttggataaaagaatctaattaagaatttgtgcatggttcttttaaaattcctttgatttttttttttttttttggcctgtttttcaagtgtccaatttttgtcacccttctcccatcaggtcagagagatagccaatggtcagaagcaatcttccagcaactgccatagcgctttctcctgcctgcagatgcctctttttagtcagcctttatgggaagtagcagcaccatccgttcccagagagcaagctctggagtagctgagctaaccccagttgctaatctgagctaatcccagttaccccagtggatttacagattgagggtagaacccagcagggttctcttcttggaaagaataggcttccctctaaggtttcacatagatactgggtgaggaaacagccctaaatggcttcagaaattgaatgttctttgggcaaagcaggaagccctgctgtggaagagcatcatttgagcataaatcaggttatcaggacaaacagagtgttcaggaggtctagatggttaagcagagagcctcatcagaatatccgtggtgaagagaaacaatcttgctgggagaaggataaccgtaactggggacttagaataaaggctaaaaatgattcaaagagaatgcaaaaagaatcaggcacaaatctttactatattctgttgtgcaaatctcaccttactatgtgtttatattctattcctccacaatctttattttatttttatgttcacagagacttgctggttccaactaaatgagcacaacagccagtgacaacagaactgcacttaaatagtccctcatcagctcttgagagcagattccttaaaggtgaacaatattccacatacaaggacttttcagcagtatgcattagaaatggaactgaatgtttattattctttatataagttggttgatacgacttttcagcttccctcagtaacattatctaaattttgtagatgacagtaaagctcagaggagttaaaccattttcctcaaatcacgtagctttaaacaggaaaaccagatatgaaaagcagatttctttctaaattaaaaaacaaaaacaaaaaaacttgagctcttgctttaccctagcacatagtctcgccatctgttttctccacaccaggtcattcatgtaacattcattcacataacaaatacaaataaatgagcggattcattcatcagatattaattcagaatctcttttgtgtctaccacactaggctcaagacgtcccagtgtctttgtctcctctccctcaaatctctccacccaatatcttgacaaataaagtagatccttcctgtacaacgtctccagaatcttttcttccttttctttcacctctgtcatcattcatgctacagtgtttacggaggatgtgttctgcagcatgaagtgtcgtgggcactagctctgcagaaagacttctgctgtccacctcaggtgctgacatgataaatgtgggtaaacctcaatcctttaatatctttatgacttctttccctttctccccagttcctgttttctcatgttcaagctctgacattcaaaactaaacacctttctctaacatgttgctttaattatttaagcattctgcctgggatattttcagttagtcatgggatttttcataaaactctcccaatatatctccaagtggccaggcttttcaatcactgcttccctccatgtgtatttcacacacacacacacacacacacacacacactctccacttaaattgaacaggtttatttctttacacaagaattcttacaaacagcccggttttctccaccatatgtccactccttctctgcatagctcaattttgattcttacactatattttacatattcttacactctgatacgatcttgtctcttattctttatggctctgctctgtaattttgttgttgttgttctgaaatatagttggacatgtaacttgtacatgacacaccttagcaaggaggcaactcatatctcagatgtaagtgaaagaagcactctccaggggtttcctatgggagtggtcagcacgctggcctcattggtggaatggcctagttacgaaaacagcaggagctttttgccttccagaaatctggaccatctcacaacccccagacagtctcagctacaaggaaaagtgataattccatcccacttttataaacacacacaaacacacacacacacacacacacacacacacacacacaatcatttaatcatttttaatcatttaatcatttttttaaaatctctgacactttagctgggcaggtctagacatgtcctcctttgctgggatgtgcctttttctgtcccggaataccctaaacttgacattttggcagcacgagttttccctttgtgactttctccttgttccctttctcctccttctttgcagagaatgagtagccactgcgccttgccctgggccatcagtgagaagacctgctcttagtagagccctgctttcccgctgaaggccttgaaatcccctgtgttccaggacacccactaaagatcaagaaagctcccctgacgtggggaattagctcaagcggtagagcgcttgcttagcatgcaagaggtagtgggatcgatgcccacattctccaagctttattatttggaccttgggtctccaaacactcaagtatccaaacccaagttagtgtctgagagcaggatgctgctttggttcaagacataggagcagcaacaatacaggcctggtgatggctccctcctggcattcagtatagtgtagatctactgtgtaattcatttgctgtttcctcaaggagctgtgaaaccaagggacatatacaactgctcttttctccctgtttctgcctgcagcttggtcctaaacctcagacaatcgtgaaatgtgcagggcagagccacctgggtaaacacagcctcggctttctgctcaggggactgaaaccaggatgtgtcaagtaactagaatgtgcctggacagatactgtagaaagcaaacccataaagttgttcatgagcttgtggacacacctgccagctgtgaataagtggctctaatcccaaacaacttacctacaaagagcctgagagctgaactgcgcaatggcccactttccagtcctcactgaagttgcacacactccggaaatctctgaacagtggcgtaaaggctttgcaaatagagttatctttgaaacaacaacacgtggaaggctggttggtacttggaacttgaatacaaggcaattttgtgcctgcaaaaacaaaaatagcaatattattcttaagatttcaacaaaacacagtgtctcatcacataatccaaagaagtccaggttacaagccccaaaatcttcggcattatgaaaaaaacagggagatcttcattcacatggcaaagagactcctcgaataacaatactgagaggacacagatgtcaaaatcatctgacgcatacagtggagcagttatgataacaatgctcctagaattaggggataacattcgtgaagtgaatggaaagttggaaagtctcagcaaatatctggaatatataaacaccaattttaagcttaagaatttaaaaaaatgtattaaccaaaactcttaggggaaataaaaagcttaactggatgatctcgataacagaatgcagatgactaagaaaaagtcaacgaacttgaaaacagaacaagaatacctacataatctgagctatagagagaaaggagtatttctgtaaatgaacagaggctcagggacaaattaaaaaatagcaaatctaacattcacattattgtaatctgaaaagaagaggacaaagaggtctttgtgggataaaactttgaagaattaatggctgaaaatgtatcaaatttgtcaaaagatataaaccaggtttttaaagttcagcaaaggtcaagcaggataaacccaaagaaacccaacccatttcaagacgtatcataatcaaactgctgaaaacgaggaaagtacaaaacaatcttgaaagcagtcaaaggaaaatgaaaaagaaactaccatatgaatgagtgtagatttctcatcaggaaccatagcggccagaaaaaaatgtcataatgttcagtaagtaacaaaagaaaaagacctatcaacccagaatgctatgtggagcaaaagtatctttcagacataaaggcaaataaatgcattctcattggaaggtaagtcaatacattctcattcttagcaagaatgctggaaaagaattagcaaagatttgagataagaaaagtgataccagaaggaaacttagaacatcgtcaatgaaggaacgaaagcagaaatagaaaatgtctgggtagacataacagactgttcttcttctcctgagttccttaaggtatgtttgatgattgaaagccaaaattgtaactttatcagaagcagttgtcattgtatcgagatgtactacatagataagataaaagggtaagtgtaatgggcctaactcttgatgaagtttctatattcaacttgaatggtaaaatattgattctaagtatactgtgaaaagttatatacgtatatggtaatccctagaccacttactaaccagattgaaataaaccaaaacaagatagacagaggaacatagaagaattaaaacaaagggaacaaaggttaatacattattaaatagatctatctaaaaacttatctatattaacattacacgtaaatgatctaaatccttaattaaaaactagagatcatcagaatgtattaaaagtaaatatgctgactgtaagaaagccacctgcaatacacttatatatcagaataaaagttatatagcagattgaaggaaaagagtgggaaagatacctcatgcaagcattaatcaaagacagctgtggtgtatacattaaaatcagacaaagtagatttgaaagcagagaaacttttcaggaataatgaaggctgctagataattacgaatgtccattctccagggaatactgttccaaatgtatatgaggacacagattttcaaaactcataaacaaaattagataagccaggtaaaaatagaaatatccaattttagttgaagacactaaaactcctctctcagtcattggtagacttagtagacaacaaatcagccaacatattggagaactgaaccacaccatccaccaatggatctgatcaacttcataacgcaaaataaaaatttagccagaaagcaaagacaaaaattaaaagaaaagtaagatcatgttataaccaggaaattaagagtggtccatcatatagaagggtgctattattgaaagagtttgaaatagtgacttagttattttgaaagagttttgaaggcattatttagctggaaatgacagaaagactgaaaatggtgaatctggaggtggatcttccctcatctatatttatcttgttttcttttgaggtctagggtgtctatacttcctctgaattacctgatcctactacagtgtctggcacagagcatctccccagtgaatatgtactaaatgagtggaaagtaattgatagattcaaaagagttgtgcaagaataatgttcattatttggcaaatcattgaatgtggtgtttgatggaagacaatgaatcaaagttgacttgaaaggtaagcccaaggccagacgtggtggctcatttctgtaatcccagcactttgggaggccgaggtgggcagatcccttgacgccaggagtttgagaccagcctgggcaacccagtgaaatcctgtctctacaaaaaaaaacaaaaattagccgggtgtggtggtatgcatctgtagttccagctactcaggaggctgaggtgggagcatcactggaacccgggaggcggaggttgcagtgaacagagatcacaccagtgccctggcagtaaagtgacaccttgtcttaaaatgaaatgaaatgaaatgaaataaaataaaataaaataaataaaataaaataaaataaaataaaataaaatataaaagttaagcccaggccgggcgcagtggctcgcacctgtaatcccagcactttgggagaccaaggcaggcagatcacctgaggtcaggagtttgagaccagcctggccaacatggtggaaccccgtctctactaaaaattcaaaaactagcggggcacctgtagtcctagctactcgggaggctgaggcagaagaatcacttgaacccaggaggcagaggttgcagtgagccaagattgtgccactacactgcagcctgggcaacagagtgagactccaactcaaaaaaatttttaaaaaaaatttttaaaaagttaagcccaaaaggtaagtaaagaggaggtctggaattagatatttggtgtatgagtgaatgagctaaagtgcaaaagaatgggcagaataaccgtgagctggagcagagggaaaaaaatcacatgcaaaatctaaaaatatctgcttctcaattcgggctttcccacttagcagctttggcatttaaaaaaaaaaaaaaaaaaaaaaaaacacttgaccgggcacggtggctcacgcctgtaatcccagcactttgggaggccgaggcgggcggatcaggaggtcaagagatagagaccattctggctaacacggtgaaaccctgtctctactgaaaaaatacaaaaaaattagccgggcatggtggcgggtgcctgtagtcccagctactcgggaggctgaggcaggagaatggcctgaacctgggaggcggagcttgcagtgagcccagatcgggccactgcactccagcctgggagacagagcgagactccgtctcacagaacaaacaaacaacaaacaacaacaacaaaaacgcacttagcctatctgattctctattacttctaaaaagtgcatactaaggcataattttgttggcaaaagtcaatcagactacatcaagtaaactccctaagtctcctagtataattcacggcacaaaaatatgaggaaaaacagggaggatatgattaaaagtttagtttgtattttttgttgagtgaatgtctccagtcatagagatgcaagtgtagatacacagtaagagtagtatgaatggcagacaccttggaaggctatttcttccttcattcattcagttggtcactcaatgaactatcatgaattgagcactacctctgtttcttatcaacaaaggagactacggaaaggaagaatgactaagatctctgaagaagggaaaagctagatgactgggccacaagaggaaaaaaagcagcaagacaggtacaattgtgtctagtccctcaagccagaaggtcctatcattatgtgaatactggaaacgggtggactccacctgtcctgagtggggaattcttccagtgcagcattgactgataaggagtgatttccaagtagcattgattgtgttctttaaaagctaggaattgataaagcagcagtgcgtgggaaatgagatttaataatctggatgtcacctcttaggaacagttgctctcttagagcagcaggccacctgtcaatctcgtattctgaaggtcctgagtttgaacatgagacaaggcacagcttatgccgctatttccattaagagaaatgaaataggtgtgataaataatggaacacaaatgctatgagataatgatttcaagacagaccaaatattagcttaaaatttaaaagtgagttttcttttcttttctttctttctttttctctttctttctttctttctttctttctttctttctttctttctttctttctttcttccttgcttccttccttccttctttccttccttccttccttccttctttcctttcctttctctgtctgtctttatttattttttccttcttttggcttctcagtcgcttgagtacaaggcgtggtgaaggcatataaattacaccagaaactgcaagctatgtcttatgtctacctctctagctgacaggggaggcaggggaaatttctcttccaattgcctgctctgaaggtcatccaaacataattatggggtggggtgggtaaagtcttttattcttttaatcgtccaaccgatagttctcaacacatatcttgttaagagactgttttgggtatagcaattcgcagtgaataaaatacagatattctcacctttgtgatactacgtcaatgttggggggagtggggagaaagagacagaagcaaaaaagaaaaataaacaagaagtcatgtgatattatctactgggagggagtcattaggcagtaaaggactcggcagtgtggaggtgacacattcacttttcaggagaagaatcagggaagttgtcaccttgaagatatcatttagcttccctttcttccaatagtctttctttacatgggaaatgaggactctaggattctccggctggatctcagcacctagagatggatctgggcaataggaactgctcagtaagcattacctactgctttggttgccttctccctggcctcttggattgagcttgcatcatacgtgttcagtaggaacttgcttagtggatttacaggttgaggttagaactcaccgggattctcttcctggagagaacaggcttccctctaaggtttcatatagaccccgggtgaggaaagagccctaaatggcttgaaaaattgaatgctctttgggcaaagcaagaagcgccactatggaagggcatcatttgggcctatatcagggtctcagtacaaagatgagtgctcacgtggtcaagatggttaagcagagaatctgaccagaatgttcacggtgcaaagaaataatcttgttgggagaaggatcacaacaattggggaattagaatacaggctaaatgagactcaaaaataatacaacaagaatcaggcacaaatcctttactactacattcttttgtacaaatccattttgcctagaaaatcataccttactatgcatccctattgtgtttctccaccatctattttactttttaaactttatttcatttttatcatcacagaagcttattgctacaaaacaaatgagcaaatcagccaatggcaacaaaactgcactgatctctctccttagaccttcagaacattttccttaaaggtgaacaatactccacgttcaagaatttttcagctctatgtgctagaaactatactgactgtttattaatttttatgtaagttggtcgatatagtttttcagcttccccaagtattattaccctagtgttacagatgacactgaagctcagagcagttaaaccattttccttagatcacataactttaaagagggaaaccagatatgagaagcagatttctttctcaatgaaaaaaatcacaagctcttcttgctttagtctagcacatagtcttatcatctattttcttcacaccagctcactcatgtaacattcattcatttaccaaatacagataaatgagtggatttattcttgcatcgatcagatatgaattcaaaatctcttctgtgtctgccacaccgggctcaagacttgccagtgcctttgtctcctctccctcaaatctctccacccaatgtcttgacaaatactgtagatccttcctgcataaactctgcagaatctttttcttctgttttactcacctccttctttatccatgctatgatgttcatggaggatgttttcttcaccatgaagtgtgaaggggattgaagctgcagaaagactcatgctgttcacctcaggaactgacacagtcaatgtggataaatctcaatcctttaatatctttatgacttctttctctttctccccagatccagtttttccattttcaagttctttgacatttaaaactaaaaacctttccctaaaatgctgcttttctacctggaattttttcaatgagtctttagcttttataatattctcccaacatatctccaagcatccaggcttttcaatcactacttccctccgtgtatattttacacacacacacacacacacacacacacacacactccacttaaattgaacaggcatatttctttacacaggaattcctacaaacattccaccctatacctaccctaggttttctccaccctatgtccactctttctctgcattgctgaatgtgttttctttattctttcactctgatatgatctttgtctcttattctttatgcctcttatctgcatttttttgttattattgttctgccatgcagttggatatgtaacttttacatgacacaccttagcaagaagacaacacatgtctcagatgtaagtaagaaaaacactctccagggatttcctggtgtagtgctcagcaccctggcctcattcctgaaagtccctcggtgtggaaaaagcaggagctctttgccttccagaaatctgcatcatcccacagcctcagctacaagaaacaagtgacaatgccatctcttttcttttaaaaaaatcatttaagcttcctgagatatctgtgacacattagctgggcagggtccttctgtgggacatgtcattttccgtctcggaatatgtgaaacttgacattttggcaacaccagagttttccctttgtgactttctccttgttcccttttctcctccctcctcacagagaataagtacccactgcactcttgccctgggccatcaatgagaagatctgctcttagtggagccctgctttcgcggtgaaggccttgaagtcgcgtgtgttctagactgcccactaaggatgaaaaaagatgctgtgagatgaagaagtagctcaagtggtggagtgctcgcttagcatgtgagaggtagtgggattgatgcccacattctccaggtttcactagtcggacctcaggtctccaggttacagtggaaaaaaatatgtgttagacactgatctcagaaaacagtaagttagacactcatctcagtagcagcctggacacttctttggctcattatgtaagggcagcaacaatacgggcttgactaagattctactggtatgtggtatagtatagatctatcgatgtgtaattagttttctgtttctttgaggagctgtgatacaaagggacatatccagttgcacttattctccctgtttcctcctgcagcttggtcctaaatgcagcataattatggaaagcgcagggcagagccactcaggtaaatacagccccagctttctgatcgggagaccgaaactaggagttgccaagtaaccaggaaagacactgtggagagcaaacctgtcaagttgtatgtgaactcctggatgcgcctgtgagctgtgaataagtggctctgatcaaagacaacttatctaaaaagagcctgagaatcgaactaagtgatagcctactttccagtcctcactggccactgggttgcacatactccagagtctctgaatagcagtgttaaggctttgaaaatagaatcgactttgaaactacaacacacaaggctggctggttattggaacttgaacacaaggcaatcacatgcctgcaaaaacaaaaatagcaatattatccttaagatttcaacaagacacagtgtctcatcacataatgcaaagtacaaccccaaaatattcagcatatgaagaaccagggcaatcttaattcacttggcaaagagaatcctcgaataacaatactgagaagacacagatgttacaatcatctgacacatacttttaagcagttattacaacaatgctccatgaatgaaaggataacactcttgaagtgaatggaaagttgggaagtcttagcaagtatctggaagctctaaacactgattttaaacttaaaaattaaaaaatgtattcatcaaaactattaggagaaaaaaaacttcaatgggttatttcaataacaaaattgagacactcagaataaagtcaatgaacttgaaaacagaacaaaaataccaacctaacctgaacaatagagaaaaaggagtgcttttgcaaatgaacagagcctcccggacaaacagaaaaataagaaaaatctaacacatcattgtaatcctgcaggaagaagagaaagaggtcctccagaaagaaaactccgaagaattaatggctgaaaacatatcaaatttatcaaaacactttagaagttcaataaatgtcaagtaggttaaacccaaagaaatccatacccagacacatcataatcaaactgctgaaaactaaggaaaaccataaaaatcttgaaggcagccaaatgaaaataaaagggaaactgccacttgaatgactgtggacttctcatcagaaaccataggggcccaaggaaacatttactaaataccaaaagaaaagacctgtcaacccagaatgctatgtagagcaaaaatatctttcagactaaaggtaaataaatacattctcacaggaaggtaaactgagagaattcattgctggtagaactgctggacaagaattagcaacgatttaagatgagaaaaatgataccagaaagagacaggacaccatcagtgaaggaacgaaagccgaaatagaaaatgtctgggtagacattacagactattattcttctcttgagttccttaaggtatgtttcatgattgaaagcaaaaattgtaactttatctgatgcagttgccattgtatctagatgtgctacatacataacataaaagggtaaaggtaaagggcctaactgctgatgaagtttctatattcaacttgaatggtaaaatattgattctacgtatactgtgaaaggttatatatgtatatggtgatccctagaccacttaggaaccagatttaaataaaccaaaataaactaggaagaagaacatagaagaattaagacaaggggaacaaatgattaataaattattaaaaagtagatctatcggctgggcacggcgtctcacgcctgtaatcccagcactttgggaggccgaggtggctggatcacctgatgtcaggagtttgagaccagcctggccagcatggtgaaaccctgtctctactaaaaatacaaaaaattagccaggcatgaagccgggtgcctgtaatcccagctacttgggaggctgagacaggagaatcacttgaacctgggaggcagaggttgcagtgaggggagattgcaccatggcactccagcctgggtggcaagagcaagactccatctcagaaagaaaaacaatagatctacctaaaaacttatctataaaaacattaaatgtaaatgatctaaaacaatgaattgaaaaccagaaattgtcagaatgtattataaatgaatatgctgactacaggaaagtcactagtaatatacttatatgtgagattaaaagttatatagcatattgaaagtaaagaatgggaaaagatatgtcatttaggcattactcaaagaaagctgtggtggatatattcaaatcagacaaaccagattttaaattgtagaaaacttccagggataaagggggctgttacataattagaggtgccaacacaccagagaaataatgtcccaaatgcatataaggacacagggcttcaaaactcgtaagcaaaattggataatccagataaaaatagaaaaatccaattacatttgcagacgttaacagtcccctctcagtaactgatagatccagtagacaataaatcagtaaacacatttgagacccgaacaacatccatacagcaatggatctaatcaatcaactttctacagcaaaatcacaatttgggtagaaagaagagaaaaaaaataaaagaaaaacaagatcatgctataactaggaaatcaggaatgttcagggtgcaaaagagtgatatattgaaactgacatttttgaaagggttatttagctgtaaatgacatgacacggagactgaaatcgtaaaactggacgtggatcttcccttctccatatttgtcctgccttctcttgaggtctgggctgcttgaatctttagaatctcctgaacttaccacagtgtctggcacagagcatcttccctgtgaatgtgtactgaatcaatggaaaggaattgacaggttcaaaaatgttgtgcaggaataatgtttactatttcacaaatcactggatgtggtgtttgaaggagaaaaatgtgtcaaaagttgacttggaaacaaagcccaaaaggtaagtgaaggggatttggggaatgagatatttggtgtgtgaatgaatggggtgctgtggagaggagtagggagtaagattgtgaactggagcagagaaagaatcacgttttaaaatctaaaacatcttctcctcagttcaagctttgacacttagcagctctggcaccttggaaacaaaacttatctgaggttccattacttctagaaagtccagattaggacacatagttttgttggtgaaactctgttggactacatgaagtaaattcaataaatctcttagtataattaatggcatacaagatttgctttacactttttgtagcaggattgtctccagtcgtgtagatgcaagaggagatagagagtaagacacagtagtatggacaggagacacctttaaagactattttttcattccttcattcgttcagttggtcagtcagtgaactattatggactgaacatgtcctgtgtgtcttttcaaaaaaggacaccataggaggtgtaagagtgattaagatctctgaaggagggagaagtcagatcactgggccacaagagggaaaaagtcagcaaaacaggtacaattgttcttggcctcttgcctcaagatggtcgtcttgttagatgaatactagaaatgggtagattccacctgtcctgaggataaaattctttgggtgcaggattggctgataaagagtgatttccaagcaccattgattgtgttctttgaaagttaggaactgataaagcagcagtgcttgggaaaatagcacgtgggatgtcaattcttgggtgagaaccgccctctttctgcagcaggccacacatcaatctcataatctaaaggttttgagtttgaacatcagagaggatacagtttttgctgctatttcagttgagggaaacaaaatgggtgcactaaataatgaaatgcaaatgctatgagataacagtttgaagactgactcaacattagcttagaatggaaaagtgatttcggttttttggagtttttttgttgttgtttgtttgttttttggcttgtcagtggtttgagtaaaatgagtggtaaagggatatagattacagaagaaactgcaagctatatcatataattggtctttctcactagctgatggaagaaacaggaaattttttgtcgagctttctgctctcaaggttacccaattgtaattatgaggtgagtgggtgaagtcatttattcttttatcctacatgtatttctcgagcacgtatcttgttaagagactgttcggggtacagccattcaacagtgaaaaaacgcatatattcttcacctttgcgaagctagtttctagttgataggggtgaagagaaacagatcagaagcaaacaagaaaaatacataagatgttatgtgacaacgtctactgggaaggaacccacaggcagtaagggacttgggagtgtggagatggcccattcagaagcttttaggagcggaatctgagaagttgtcaccttgaagacatcctttacccaccctccaccccctccccactccccactcctgctccttccttcaatcatctttcttcacgtaggaaatgaggactgtgggattctctggctggatcccagcacctagagagggatctgatcaataagaactgctcagtaagcattacctattgctttggttgccttccccttgcagagtgctggcctcttggattgagcttgcatcataggtgttcagtaggagcttgcttagtggatttacaggttgaggttagaacccaccgggattctcttcctggaaagaacaggcttccctctaaggtttcacatagaccccgagtgaggaaagagccctaaattgcttgaaaaattgattgctctttgggcaaaacaagaaaccctcctatggaagggcatcatttgggcatatatcggggtctcagtacaaagatgagtgctcaagaggtcaagatgcttaagcagagaatttcaccagaatgttcgtggtacagagaaacagtcttgttgggagaaggatgacaattgaggccttggaatataagctaaataagcttcaaaggggatacaaaaaagaatcaggcacaaatcctttactacattattttgtacagctcaatttttgcctagaaaatcataccttactttgcatccctattgtgttcctccaccatctattttgtttttttaagcgttatttcatttttatgttcacagaagcttgttgctacaactaaatgagcaaaacagccagtagcaacagaaatgcgttactatctctcctcagaccttgaaagcattttccttaaaggtgaacaatattccacatacaaggaggttttcagcactatgtgctagaaattatactgaatgtttcttaatttttacgtaagtcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacattaatgtaatagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctggggggcatatagagccactcagagccttagaggtacgttcagtgaaatggagccaatcaccatatagtgtagcctattgttcgtctgaccaaaatgcactatgttgcgatagcatggattctacagacccgtgaagcccatttggaccacaagacactctttccatcatgcctgcacacctatccttcactcttcattggctcatgcagacttttgaaagtatttagcaataagcatcctacccccaagaagcttatggtctcatggagaagatggccaagcaacagacaatcccaacatggtgaatgccgctaaaacaaatgcgtacctggatctccgtgagtgctaggaggaaagcaacccaaactcagaaaagtaggagaggtgtcagggaagacattttccagaagatggtttcgtgtctaacaaagccgtgagacgagcaaagaggaggtgaaaggctcagcgttctatggggacatttccttaagtccagtatctctagagttgagtgagggaagctaaaagagaggaaatagaaatgaaaaatgggagttcttgagaggctttacttaccctgcacaagccaaggacaggtctgcgggaagtaagcagatgcacagttaggaaagcccatatcaggagttagtcacgacagagaaagatttgtacactttggaaatcgtaaaagaatgaaaagcccaggtccttatttccctgttttcgtctctgtttttcacgttcctcccggatttcaatttctttctggaatcttagctctcttcgtcatctgctcttgcaggaacactgaactgcaaacgcaaccctacgattcagcgaactacgtcctatcaaggttactgggtacaaatacatttactttcgtgagttctcttgtgactttctgtatcactgcccacagttgctactgtgagacaagcattagaagtctgtgtagattgctgggttcacacacatttacattctttttctcttgtgagctttgacgtggctacacataattgttactgtgaaataaacattagaaaagcctgtggcccgtgaaataaacattagaaaagcctgtggcccgtacggggatcgaacccgcgaccttggcgttattagcaccacgctctgaccaactgagctaaccggccccgccggcggaacggaccctacctctcttgagaagtttaaaggcgaacgttattccaatcaccaaagaaacttttctgaagttcttggagttggaaagaacctacgatctttgctaacttggttacgatcctcggcaaatttcttctaacctggaaatttcagttaaaatacaattctgcggaaggaaagttcaaatgtcacctgcttcagtgtttcacgacaaagggtttcagtgaccacccttttaaacgcaacgccatcaccgtccgccggtactgtggcctgtccctatcactcctttctactttgcttccgtagcttctgagcgacccgtgaagaaattgacggaaaacggaaggaattgccgccagttcctttccacgggccgtcaaggccagtataagtccccacccaggctcctctgctcgtaacttctagcacgattcccactgaattcgcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacatttcgaataactgaataaaggaaatctcaaccaacccccttgccgtattacaggtggtccagctctctgcctagactattgtgctaatgtcctgttccttctcccggcttttgaactagattctcacctctctccaatccatctttcgcagggctggcctgtctttccgcctcacttctgaaattctatccattgcagcctctatgcaaaccgactctggttaatacttcagtcggtatggctcccctcttccgcactttgcactgcgagaaatgcccttccttgaggcagctggaggcctcctcctcctgagagcttaattgtggacacagtcttgagtagaggcgaaaaggaaagaaggctgggagataatgggggaaaagcacacctttggtctggtttgaaagctggcgcccgaaaaggggagcgaaaggacaagaaaaaaaaacacgctccgaaagtgtctgagattgctgcggccataaagcagagcactaaccgcggtactgataagggaggggagcagggctccgccgccgggcctgtgcccatggatctaggtgaggacgggcactccttcctccgcggccaaatgttgcatttcccaagaccaccctggcccgccacgcccccatcctgtgcctataaaaactcccgagaccctagcgggcacggacacaagcggctggacgtgaagaggaacacaccggcgggagaacacagaacacccaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgagctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaaaaacaaaaaaaaacaagtgttctagatttgcagaggaccttttcggagctaagttccagtagctatactgtaagttgatttcttgggcagttctgttggtgaggaaagagggcaaattgagaaatgaacaaacacagaagttgcaaaagccctgtgacttacagcacaggacgagtctacaaaccctgccataccacactaagctcaaattgttttaacaccagcttactcagacccgatgatccaagataagaccaaagccaaacggatccagcaactctgcgcagatcttcatgttccagcagctaagttccactgaataaacctatgattcgcctagtttagaaattctggccgtgcgcggtggctcacgtctgtaatcccagcactttcggaggccgaggcgggcggatcacaaggtcaggagaccgagaccatcctggctaacacggtgaaactccgtctctactaaagatacaaaaaaaattagccgggcgtggtggcgggcgcctgtagtcccagctactcgggaggctgaggcaggagaatggcgtgaactcgggaggcggagcttgcagtgagccgagatcgcgccactgcactctagccgggacgacagagcaagactccgtctcaaaaaaaaaaaaaaaaaaaaaaaaagaaaagaaaagaaaagaaaagaaaaagaaaaagaaattctgtccagtccctcctgagaaggaccttactaaccttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcatttttgtcatatgacactacttgtattttacaggattcacttggtctccatctgacctcctcagagtagactgctctttcccaatcactcctgcaattaccctaggagatgtgtgatcctaaagtaagggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaatataaaggcaagtatctttttcactcagttcaccttggttctaagagtgggtctatataaagaaatggagcatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaattaatcatgttataaacaatatgaacataaaagcaaaaattgcaaggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctaatgcatctacaaaaataagcattataagtaaatgcagctatgtcacagattacaatatacaaaaattaattgtatttctatgtactagcatcaaaaaaatggaaaattaaattaccactttcaataggtttaaaacaaatgaaatatttagagataaacttgtcaatgtgcacaagacttgtacctagaaatctactaaagattgctgagaaaaactcaggaaaacctgaataattggtggtgtttgccatatttacagattgagaaatttaatattatttagataactttttttttctctgagttgatctatagatttagtacaatcccaacaaatatcccagcaggagtttttgttttgttttgtttgtttgtttttacagaaattgacaagcttattctgaaggacttagagtaacctaaataattaggaaaagaaaaacaaagttagaggacttacaccaagtaatttcaagacttactataaagctaaggtaatcaaaataatgtggtattgtctcaaggatacttacccagattgatggaatagaatagatagtccagaaatagaccaatgtatgtggtcaactgatttatgacagaggtaaaatgtttttttaaacaaatggtcccaggcaactgagtatggaaaaaatgattccctacccttaactcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaaaataagatgcttatatggccaataaggcacactaaaagatgttcaacaacattaatcagtacaaaaatgcaaattaaatctatcaaggattaataggtaacaacagatctcaactcccctgaatggagaaacaattagtaacacagatactagataagttacttgaaggatcaatcgataaaaagatacttgggcttatttccaggtttgtgttcttaaaaagtgatgcattcaacagagcatttgaggtaactgctaattagggacggtacttccttctctttcatctaatgggagagtgaaatcagattagaactagtgctttcctaatgagatcttttctctctttctcaggatcccgactcagattgaaaaagcagaggatggtcactgccttccaggtctgaggctgtctcccagaaacttcattcctcgcttcgccttggtagggaagttcccggaggtgtttgaaaagctggaaacttaagtgggacatggaacgatatttgtgtcccggttatcaaaacaggcagaaaagacaaatgcggtgtgggggaattggctcaagcggtagagcgcttgcttagcatgcaagaggtagcaggatcgacgcctgcactctccagcttcttttaatccctaggctaccaatggtatctggtaaatactttcagcggatttaccgctctttatttgactcagtttcatcttgttatgtacattttttttttaaggaaattatacatagcattccatgcaaaagcaaaaaaggaagcgattagtcacaagtgagttttgccaatacaggttttggggcttcagctcgaagttaatacaatgtatttttgtggggaaatcaaactttagccttttgggtacaaaatatgaggaacagcctggaaatagtgtcaggaggcaaaagcaggagacttgaatgtgccaaccttttgcttttattcacattgacaacacatggtcaggtagaggatgaaaacgtgtcttctaccagattatctgagagttggccaggctcccaccttcacttatactccttccttacctctctcctgtgtaggtaagagaggtaaggagagaggtaaggaaggagtataagtgaaggtgggagctagcatattaactctagtggtcggatacactctcactaagaaaagtgacatttattccttctattcatctctctgaaagctcgttctgacaaaaatgtgctcaaaataaatggggacctaggtcttcctctaatttccaagatgaaccaaaacgtaaaaaaatgtatttttgaaattgcaacactatcccctatttaaagaaactacatgaggcgctgtattaacaacacatatgttgactagctcaactggcccaagcagagctcagaatgctggagagagtggtctttggatagatgactccaggaagctcttgtaggtccctgggacgtgcccctctttccatccttctttctttcccatcactcaaatctctctctgacaccatttgacttctcagcattgccctttgttaatcgtaatagaaagacaatgttattgattacatgtttttctattttatcttcttattcataaatgatctcaaaaatgaatgtcataaataataaacatgttgttgaatttttgtcccataggagcagcctctttccttctcaggatgtgcactcctaataaactgggaccgtgaaggagggacctgaagctgccccaaaccacctgcagttccatgaaggccatgcctccacccactaatcactctgaaagtagtgcccctccactcttccccaaccacatttccttttcaggcaaaaacatttctatgggtttgttagaccctagcttctaatcctttcttcagtctttactgatctgaagccactctctcctttgaggcttctaaattatctgtatagcctttctccattcagcaaattttcatcaggcaaaaatcctacttgacgctagttatactcagagtaaaataactatgttcctgtcttaaatgagaattcttcacaggtggaaagcagatttggaatccactacaactccaaggcagtggagctaatgtagcctcccctgggctacaggggaagccttcttctgtgggcccgggaattgaagaactagacaggcataagaaggacaagtgtggtgcccaatggagcaagagaaggggggaggaaggtgacagggaagggaaatggcaggagaagcacctacacagcagacacggtatagcctgcatctgtttttccttttggctgagagatccctgagctctgtggtgacaattttccataatttttcatataaaaaatgaagattataaactatttctaggcattttacctgcattactattaatatgtgtacagcatctaaaatagggtctagacggcaattgcacagtactattacttgctattgttgtggcactttctatgtggatcactggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggcgcgtatggcgtgaagttctggggctgggagaagctgccccactacttccgggcggccttgcctgcagggagcaggtgaggatcacagctctagagcgggctgcaatagctgtgcccgcaagccaggcagttccgggtggtgcttctccaactggaacgtgctctctacttccgagagatgaagaaggcgaaattgagaagtgaggagagaggtctccctcatgacctattttggaaatccgtattcttcacactctcaggctcgtagaactttgcccaaggcagtatctgagaagctccgccctcaatcttgtcctgccagggatttggcggcccaaagtaccggcaggctcctgataaccaggaaaatgggtggggggtggtgtatcctcagtggggaattagctcaggcggtagagcgctcgcttagcatgcgagaggtagcgggatcgacgcccgcattctccagttccttgtccggtttatgtctcttggtttgtatacccgcttctttctcctgttgacaacggcggtgcttcttacctgggagaagatcagaggaacctgccccctcccccgatctcgtgttttactgctccccatgtaagagtcttgttgcccctgcttccatcctcccatgttttccactcctgccacaggtttggcacttctagctactcaggtctcaatgcaaatttcccgtctttagacaagtacagctaaaagtgatgcccacacgatctctcaattcctactacatcttcacaaatatcgtctcctccagaaagtatgtctttaagttactggtttgtttttctctcccctagagtgggagcttcctgagtaccgaaacgctgtctatgtacactgtgttcaactcgcttcatccccatgcgtagagttaaggttctgtaaaatacggttactgccttgaacagataaggaaacagggagatcaaagacagagcaatacttaaaaacattatcctgccacatttctcaaatcttaataatagcattcactaatgtttttggtttttctttgtgctttctccatatccccttattattattattattttacatttggctgaccattttacacttctttttcaaatgaccaatcagattttgcaattttctagttaattcctgtgtttccttcaccattctattttctttttttttttctttttctttttttttttcgggcttcttcttcttcttcttcttcttcttcttcttcttcttcttcttcttcttcttcttcttccttcttatatttaatgcactgatttcttctaatgttttgtaacttgggtattaaaaggtgtaatttaaaatgagaaagcagtttctacagagtccttagaaatatgtcattttaagtccccattttcattatattctaaggagctcgaagatatacttttgattcttttctaaactgtgcattcgagagttaatctcttcttgtttacttttacgttcattctttcaatgttattttctaatttttgtgtatcattttgtttatcaacacataaatatgtacattcacataagtatacgagttatatatacatgtatttatgaatggcagctgaaccacacattagtgctaatattggtgactaaaagttggagaaccagacattatgtacctcataaagcgaagcaatggaaagtgcacaagcccacctatcaaattgtcttgttaaaagatttgaagctgaatctaagtgagcctctacttgtaactaccagtttacaagaaatagagtaggtgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgttaaaaaaaaaaaaacccaggatgtataacacaaagagcaaactgtaatgtaaactgtggacttcagttaacaataatgtattagtaattactggtttaccagttgtaacaagtgtaccatactgatgcaagatgttaataatagggaaaattgtaagagaggtagagtgatggagtttatggaaattctatctattctggtcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaaagttaatattagatcatatttatgatctattaccaatttgttaacaacaagtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggacgtggtagcgcacgcctgtaatcccagctactcgggaggctgaggcaggagaatcgcttgaacctggaaggtggaggttacagtggatcgacatcgcaccactgcactctcaaaaaaaaaaaaaaaaaaaaaaaaagtctttattgaaagtttcaaacttaaaagtgctctcacatataaataaaatcattttctctatatacatggtttttgcaagtgtacatgtctagacaccctaggaatggtggtgccgtggtgtgaacgtggagcctggaatggccagccccaaaacctcctcctcatcaactgttgactcgtcaacagtcagtcagtaatcaaaacttccttaaaatacaaagagccgcagaacattccgggatatctgtgctacttaatctggcagttcctactgtgtcttgcccccggtgtgacgtgctctcttccatgaaattaataactgcaaactgtaatgggaacaatgcaattgattgtctccgcactcttgcccaaagcgttctctgagatgtttggtagttatttgggtccttacttgaccttcgtggccttaaaacaaagggaacatggcatttgtgaatctgaaagaattgtgataattttctcatttcctcctggctgtgtgcatcaccctgagtttgcggagggatcagccctttttcagagccccctcacgtcctgagtatcatcctcagaatgtggggcttgggctcaatttgaagagggtgtgagggagagccaaaatgcagggattgtcccacagtgcagtcctgctttgtaaaccccttcctctgactagcttgattttagtctctgagaatggatggggtgggatggcttttcagtactttctgctgagacatttttgtatattcatttctctctcaaggagcctctgtaacaaaagagaaaaaactgtctcgggttctgtgtgtggcacatgagtttgaaggatttctgagactattgttcaggactggcgttacagatgaaatatagattcaggaccagtgacggtgggatccttggcaggcggacataacgcctcgttaaggacagactgcccaccactctctttctttctttctctctttccgaaatcattttctataaattccactgggtatcagaaccttccttaggctgactggcgcttcgcagtctcctctccaagcccggatctattccccaaaattctctcgttcatgcttctagcttctcttcttagcttctctaggttcgcgtcatcggctttccttgtttcccaggttgaatccccagttccaagcggctcctgtaacagggagtgggagcccaccctcccactcgccgtgtagcactctgcatctctgagaagaaagtgaccaccccagcccagcacagattttcttcgtctttgagcacctgctcggagttcccgcccctcgtcgctccttggttttccctcattgcctacatagagtctgttggatgtcggtcaaggtatccccagcccctgccgtgggaaccgtttggggaaaaacagacctgatttatttatacttcaaagatgcccaatgattccctgtcgtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaagtgagcgggttacaaattccgctaaccccagcccgccaccccgctattggctatttgaggcatgtgggggatttttccggactagaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaaggtaagcgttcacttgcaaaagctgccctctctgaggctcgaactcaggaccttcagattatgagactgacgcgctgcccgctgcgctaagagggcgacgaagtgcatcaacgcgccagcttccacaggaatttcctaatttctttccccaggcgggttattttgggacttcagttttcttcgcccaaggtcgctagttttccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctctcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaataccctattaaagattttattcccgtaatttcatttagtccaatttatttatttatttatttgccataaatctatacatcattatccccatcttactgatgaaactgaggctcagcagaactaaatccacagctgataaggggcaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacctgccatgtacccggcatttatgctctagatttccaaggcatccttggccctttatccctcacatccctacaaacaccttaaatcattagttctcgaagtgcggtgcccagacccaccacataattctcgaggacacattccatttcaggtactgtgctacccgaaggctttgaggattcagaggaaattgagccatccctgacctcaggagctgacaggacaaactgtcctatctggtccggttcctatactctcaaacttccggattcttataaatgcatcttcctaaatattttattttgatactgtaactcccattctgcactagtttgctagggctgccataataaatatcatagactgagtgccttaaccaacagaaaattttctcagttctggaggctagaagggttgttagctttggtttctcctgaggcctctctccttggctcgcagatggtcacttaccttcttgctatattctcccacggtctctctctctacacatgtttccatcttttcttataagaactcctattgggagttagggtttcgacatgaatttgatgacaggtggggcgggacaaaattccaccatgacaggctcaaagttgtttacattttcaccctcatatttgcagtagactttgttactggaaaacactacttgcttttttttttttttaacacgtattttaaagccccttaattaaacagaccatatacctttccttatctaggaattcccattccagtgcctggtccacacatccattatttctcctcatctccattcctcaaggcccattcttgattctttcattcttatttgaaagaatgtagcatggaggaatgtagcatactagtttttccctcggaattgcatgactcattgtcatgcaaattacgcagtctcaggtgttccttttagcaacacaaagtagactaaggtgtgtacatttttgtacttgtcaaatgtggttagaataccaaatgaggtactgcctcacagatccctgagatgtcattacttggcataacaaaatcataatatagatatcataataatgcataagcagacaggaaaaaaccataataataacaaaactcattaagggatagccacgtaagtttatcagttagttctctctaaactctgtaatatgaatgtggccaatctctgggatttaataatacaaaaaacatgttttggtctcccagtgtcattttaatcttattcagtaggatatattctttccctatctccatatgaagacatacacagttttatgcctcatcccaggcaatacagtctcagtctcaaagttaagatgctgagctccatgtaacactctaaaatttaaacttgacataaagatcagatctcttcctttacctactgggcctgttgagtcagctaaaactatttggatagttttctaaggaaaatgtttcatctctcttttcttaccctaacattctaccatttgttaaccactgttctgagacttccgtgtttcaatcgtggtggaagatgagttaaagccagggaggggtggtggggagaataataaagttcttacttttaaatggtgttgtcattagccagtgtcatgctttccattcagctgtttgaatacgaataatttttttaatacgatccatgattgtggattctcgtgtgcatttcccttgatgatgatgtactctcctgtacccccttctttatgactgcttttccagccactgcaaaactcaaagcttccttttgcttctttttccttagttacgttcatccttccacatagcccactgggactggctcaaagttgacctcatgctagtgctccctctctcctgattcccacacctgtcttgtgggaaaggcctacatctggttgtccctgaaaagccctgggactacaggccaatcccaatatagaaggaacttcaggcagtcaatctgcccatttctcccctttacatttctcatgcatctaactaccgtatctcccatattttggtgccagtgattgaacttgttggcacctgtattagtccattgtcacactgctataaagaactactggagactgggtaatttatgaagaaaagaggtttcattgacccacagtgccacaggctgtataggaagcatggctgggaggcctcaagaaacttacaatcatggcggaaggcgaaggagaagcaagcatgccttaccatggcagagtcggagagaaagagcaaaggggaaagtgttacacacttttcaacaaccagatctcaggagaactcactcattgtcatgagaacagcatgagggaaatctgtctggaacaggtttgtgaacccattgaggtgttcatccagtgctgtttcagagaaatctctatttcaatctattcctatacattagttactgaaaaacaacagacaatcacaaaaacaagttgacctttttgtgatccttgagcccagttgcgaagggccctcgtgaccgggcctcatgccaaacaactcgttacaaaaagagctagggttccagactgggctgaagcttcatgagacttctcctcgtctgtgcgcagacagctggccaactctggagcccaggctgttgcttcccggtctgttggtgaatcctccatagtctggtgagtgtacatatatatgtatatacatatatatatatatatatatatatatatatatgtctttttccttcccattgcaatttgcttattatatcagtctgcttattatttcatttgcttattatatctgcattgccatttacgtgggataaaggttgtttacccttaaaggtgttgtgtgggtgtcttttcttctccctttacatgtcttccacacagaacatgtacacatgtatctacaggtgcatgtgtgtatgtagaagtgattgcacctgtgtttatgtatacatgtctgtgtacaccacatgcatgtgtaaatgtatgtgggtacacgtgcatgcatgtgtatgcatacatgcatgtacacatgcacaaaggtatctacacatacatgtgtatacatgcatgcatgcatgtttatgtatacatgcatgtacaccgtatgtatgtgtgtatgcatgtgtgtattttcagacgcatatgcatatgcatacatgcatgtacttgcatgtgcacacgtagctgcacattcacgtgtgtatgtatacatgtatgtacacgtgtgtgcatgtgtgagtgtgtaaagatatgtaaacatgtatgtgcaaatgcatgtgggtgtgtgtgcatggatgtaggtgtatccatgtattgtgtacacagtatgcatgcatgtatgtgtgtagatatatgtgcagatagacatgtgctcacacgtctgcatgtatgtgtgtacatgtgtatgtgtttacccacgtacgtgtgtatgcacgtgtgtacgcatgcatgtacatgcgtatgcatgtgtgtatgcatgcatgcacatgcgtatgcatgtgtgtatgcatgcatgcacacatgtatgcataaatgtatgcattgtgcacatgtatgcacatgtttgtatgaatgatgtatatatacatacacgtatacaccatgtataccagcctacaaatgcatctgtgcacacacatgtgaaggcgtgtgtatgcctgaatacaagtgtccatacatacgtgtgcatatccacacatacatgtgtacaacacgcatgtgtgcacacatgcatgtgcacacacaaaaattcgtgtgcaaacacatgcatgcatgacatatatgtgtacatggatatgtgggtatacatgcatgtgcatacacacgtgcacgtgcatgcacacatgcacacataatacatgtatatatacatacatgtttgcgtgaaaagcacgatgcatacatgcacacaaacataaatgtgcatacgcacgtacttgtgcatacaaatgcacatgtgtacccatacatgcattcagacgtttgtgcaatgtatacatacacctataagtacatacacacatatacactcatacatgtttgcacacacgcatacgtacacacatgcacgtgtacaaatacatgtgtgcgtgtgcatgcatttgtgcatattcattgattgtgtgcacaatatgtatgtgtgcatgtatgtgtgtatacgtgtatgtgtagatgcatacgtgtatgttaacatgcatgtacactcatgtaaacatgcatcaacacatttatacacgtatttatttgtgtatcaggtttgtatacacgtacctaaacatgcatgcgagcattcgtgcatgtatgtacacgagaatgcatatgtgtatgcatacgtgtatgtacacatataagcacaggcatctacacgtgtgcgtgcgcacctatgtgcacacttatgtatacatgtatgtgcacgtgcataaatgaattaagaaagaaacaattcacccaaacaaggaggaaaagatgaacatctcaagtacctatgagcatttttacatgcagaccccttactgacattggccaagacagatgacaagagatcatcaaggagagagttcattagaaaaagatactgctaacattagagaaacatagcatcaatcacccatagcatggatgctgttgagcttccacctgaaaaacaaacaacaacaacaacaaacctggcgggtagaaataggaacaggtttagcattacatccctccctccttttcctgggacctgcattgggccccataagcttggcatgaacctaagtgaataagacaccaaaggactgaagtttaccactaccttcagaattaggactcagagccaggaatttctttagactacataaccagtctatgcatatgtgaggatttggactgtagttcacactggctgcgcttccttatggaaacagtgactacaagatggaggatattaatgaaagatagcacacatctatactaaatgtcataacagcaaaaaccataagatagttactgacaatgagtcatgcaattccgagggaaaaactagtatgctacattcctccatgctacattctttcaaataagaatgaaagaatcaagaatgggccttgaagaatgaagatgaggagaaataatgggtgtgtggaccacgcaatggagtgggaattcctagataaggaaaggtatatggtctgtttaattaagggactctaaaatacttgttaaaaaaaacaaaaaaaacagcaagtagtgctttccagtaacaaagtctactgcaaatttctttctgtacatgggaaataaggactgtgggattctttgggtggatcccagcacctagagttggatctgatcaaaaagaagtgctcagtaaacatttacctactgctttggttgccttccccctgtggagtgctggcctccaggattgagcttgcatcataggtgttcagtaggaacttgcttagtggatttacaggttgaggttagaacccatcaggattcttttcctggaaagaacaggcatgtgttcttcccttccctctaagttttcacatagacactgggtgaggaaagagccctaaattgcttgaaaaattgattgctctttgagcaaagcaagaaaccctcctgtggaagggcatcatttgggcatatatcggggtctcagtacgaagatgagtgctcaagacgtcaagatgcttaagcagagaatctgaccagaatgttcgtggtacagagaaacagttttgttgggagaaggatgacaattgaggctttcgaatataagctaaataagcttcaaagggtatacaaaaaagaatcaggtacaaatcctttactacattcttttgtacaaatcaatttttgtctagaaaatcataccttactatgcatccctattgtgttcctccaccatctattttgtttttttaagcgttatttcattttcatgttcacagaagcttgttgctacaactacatgagcaaaacagccagtagcaacagaaatgcattaatatctctcctcagacctttaaagcattttccttaaaggtgaacaatattccgcatacaaggactttttcaggactatgtgccagaaattatactgaatgtttcttaattttcacgtaaatcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacatttatgtagtagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctgggggcatatagagccactcagagccttagaggtaccctcagcgaaatggaaccaatcaccatatagtgtagcctattgttcatctgaccaaaatgcactatgttgcgatagcatggattctacagacccgtgaagcccatttggaccacaagacactctttccatcatgcctgcacacatatccctcactcttcattgattcatgcagacttttaaaagtatttagcaataagcatcctacccccaagaagcttatgatctcatggagaagatggccaagcaacagacaatcccgacatggtgaatgccgctaaaacaaatgcttacctggatctccgtgagtgctaggaggaaagcaacccaaactcagaaaagtaggagaggtgtcagggaagacattttccagaagatggtttcgtgtctaacaaagccgtgagacgagcaaaggggaggtgaaaggctcagcgttctatgggacatttccttaattccagtatctctcgagttgagtgtgggaagctaaaagggaggaaatagaaatgaaaaatgggagttcttgagaggctttacttaccctgcacaagccaaggacaggtctgcgggaagtaagcagatgcagttaggaaagcccatatcaggagttagtcacgacagagaaagatttgtacactttggaaatcataaaaggatgaaaagcccaggtccttatttccgtgttttcgcctgtttttcacgttcctcccggatttcaatttctttctggaatctcacctctcctcatcatctgctcttgcaggaacactaaactggaaacgcaaccctacgattcagcgaactatgtcccatcaagattactgggtacaaatacatttactttcgtgttctcttgtgactgtctgtatcactgcacacgtttgttactgtgaaacaagcattaaaagtctgtgtagattactgagtacatatgcatttctttttttttcttttttttttattatactttaagttttagggtacatgtgcacattgtgcaggttggttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtaattctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatggtatctcatagtggttttgatttccatttctctgatggccagtgatgatgagcattttttcatgtgttttttggctgcataaatgtcttcttttgagaagtgtctgttcatgtccttcgcccactttttgatggggttgtttgtttttttattgtaaatttgtttgagttcattgtagattctggatattagccctttgtcagatgagtaggttgcgaaaattttctcccattttgtaggttgcctgttcactgtgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggttttcatggttttaggtctaacgtttaaatctttaatccatcttgaattgatttttgtataaggtgtaaggaagggatccagtttcagctttctccatatggctagccagttttcccagcaccatttattaaatttcttttcttgttctcccgtgacttttgatatcactgcacacaactgttactgtaagatgaacattaaaaagtcacgtctggccagtacggggatcgaacccgcgaccttagcgttattagcaccacgctctaaccaactgagctaaccggccccgcttactaaaaccccccctaaacctcttgagaagtttaaaggcgaacgttatttcaatcaccaaagaaacttttctgaacttctcggaactggaaagaacctgcgatctttgctaacttgtttatgatcctcggcaaatttctccgaaccctgacatttcaattaaaatacaattctgaggaaggaaagttcaaatgtcacctgcttcactgtttcatgacaaggggtttcagtgaccacccttttaaacgcaacgccatcaccttccgccggtactttggcctgcccttctcactcctttctactttgcttccgtagcttctgagcaacccgtgaagaaattgacggaaaacggaaggaattaccgccagtttctttccacgggccgtcaaggccaatataagtccccacccaggctcctctgctcgtaacttccagcacgattcccactgtattagcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacgtttcgaataattaaataaaagaagtctcaaccaacccccttgctgtattacagatggtccagctctctgcctagactattgtgctaatgtcctgttccttctcccggcttttgaactagattctcacctctctccaatccatctttcgcagggctggcctgtctttccgcctcacttctgaaattctatccattgccgcctctgtgcaaaccgactctggttaatacttcagtcggtatggctcccctcttccgcactttgcactgcgagaaatgcccttctttgaggcagctggaggcctcctcctcctgagagcttaattgtggacacagccttgagtagaggcgaaaaggaaagaaggctgggagacaatcggggaaaaacacacacctttggtctggtttgaaagctggcgcccgaaaaggaacaagaaaaaaaacacgcttcggaagtgtctgagattgctgcggccataaagcagagcactaaccctggtactgatacgggaggggagcaagactccacccccgggcctgtgcccatgaacctaggtgaggaggggcacttcttcctccgcgcccaaatgttgcatttcccaagaccaccctggcccgccacgcccccatcctgtgcctataaaaacccccgagaccctagcgggcacagacacaagcggttggacatgaagaggaacacaccggcgggagaacacagaacacccaccctctctttagtcaccctggaggcctcggagaaggcggtttcagtgatccgtgaagagaccctgagtcttttacatcccggagaatgacaagagagtacctgggcgacgtaactttctgggttttccggagatgcggttttctacacgccaggggccaagcctgagaaataggtggacggcaaggacaggagctctctccgcgccacaaacgcccctgctcacacctgggttccttgattttcctgcctatataaccgagccacccatggccgggctccgagctctcattctgcggactgggacaaaggggttaactgtgatgtgctttgtataaccccaggattctgcacttgcccaagggcgaggtgcaaatccaaaatcacgcacgactgaacgccgagatcagctgagtcctgagtgcctcacgacacaaaatccgtatgatttttaaaagcgctgtatttgtgctgacaatgcatgtcagatcccatctgtctttagctcaatgtgtgacgttagacacgtcgttttgctcctcaactttcttatttggaaaaaaaaaaacgagtgttctagatttgcagagggccttttcagagctaagttccagtagctatactgtaagttgaactcgggcagtcctgttggtgaggaaaaaggacaaattgagaaatgaacaaacacagaagttgcaaaagccctgtgacttacagcacaggacaagtctacaaaccctgccatgccacactaagctcaagttgttttaacatcagtttactcagacccgatgatccaaggtaagaccaaagccaaacggatccagcaactgggcagatcttcatgttccagcagctaagttccacggaataaacctatgattcgcctagtttagaaattgtctagtccctcctcagaaggaccttactaactttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcgtttttgtcatatgacattacttgtattttacaggattcacttggtctccatctgacctcctcagagtagactgctctttcccaatcactcctgcaattaccctaggagatatgtgatcctaaagtaacggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaacataaaggcaagtatctttttcactcagttcaccttggttctaagagtgggtctatataaagaaatggaacatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaagtaatcatgttataaacaatatgaacataaaagcaaaaattacatggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctagtgtatccacaaaaataagcattataagtaaatgcagctatgtcacagattacagtatacaaaaattaattgtatttctatgtactagcatcaaaaaaatggaaaattaaattaccactttcaataggtttaaaacaaatgaaatatttagagataaacttgtcagtgtgcacaggacttgtacctaggaatctacaaaagatggctgagaaaaactcaggaaagcttgactaattggtgttgtttgacatatttacagattgaaaaaggtaatattattaagatatcatttttttccctctgagttgatctatagatttactacaatcccaacaaatatcccagcaggagatttttgttttgtttgttttgttttcttttctttttgtttgtttgtttttacagaaattgacaagcttattctgtaggacctagagtaacctaaataattaggaaaagaaaaacaaagttagaggacttacaccaggtgatgtcaagacttattataaagctaaggtaatcaaaataatgtggtattgtctcaaggatacttacccagattgacggaatagaacagatagtccagaaacagaccaacgtatgtggtcaactgatttatgacagaggtaaaatgtttttttaaacaaatggtcccaggcaactgagtatggaaaaaatgattccctacccttacctcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaatataagatgcttatatggccaataggcacactaaaagatgttcaacaacattaatcagtacaaaaatgcaaattaaatctatcaaggattaataggtaacaacagatctcaactcccctgaatggagaaacaattagtaacacagatattagataaagataagttacttgaaggatcaatcagtgaaaagatacttgggcttatttccaggtttgtgttcttaaaaagtgatgcattcaacagagcatttgaggtaactgctaattagggacggtacttccttctctttcatgtaatgggagagtgaaatcagattagaactagtgctttcctaatgagatcttttctctctttctcaggatcaggactcagattgaaaaagcagaggatggtcactgccttccaggtctgaggctgtctcccagaagcttcactcctggcttcgccttggtagggaagtttccggaggtgttcgaaaacctggaaacttaagtgggacataagacgatatttgtgtcccggttataaaaattggcagaaaagacaagtgtagtgtgggggattagctcaagcggtagggtgcctgcttagcatgcaagaggtagcaggatcgacgcctgcattctccagcttcttttaatccctaggctaccaatggtatctggcctagatgacagttgcacagtactcgttattgttgtggcagtatctatgaggattattggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggctatgccgtgaagctctggggctgggagaagctgccccaccacttccgggcggcggtggcggcaaggagcaggtgacgatcacaactctagagcgtgctggaatagctgtgcccccaagccaggcagttccgggtggtgcttctccatccagaatgtgctctctgattccgagagatgaagaaggcgaaattgggaagtgaggagagaggtctccctcatgaccttctttggaaatccctattcttcgcactggcaggctcatagaactttgctgaaggcagtatctgagaagctcggccctcaatctggtcctgccaggggtttggcgacacaaagcaccggcatgctcctaataaccaggaaaatgggtggggtgaaaagtttctcctctggggaattagctcaggcggtggagcgctcgcttagctatgcgagaggtagcgagatcgacgcccgcattctccagtttcttgtctggtttatgtctcttagtttgtattccccgttgtttctcctgttgatgacatcggtgcctcttacctgggagaagatcagaggaaactgccgcctccctagagcccgtgttttattgatccccgtgtaagagtcttgttgcccctgcttccatccttccttcttttccactcctgccacaggtttggcacttctaggtactcaggtgtcagtgcaaatttcccgtctttagacaagtacagctaaaagtgatgcccacacgatctctcagttcctattacatcttcacaaatatcgtctcctccggaaagtatgtctttgaattattggtttgtttttctctcccctagaatgggagcttcctgagtaccgaaacactgtctatgtagactgtgtttaactcacttcatcaccatgtgtagagttaaggttctataaaatacggttactgccttgaacagatgaggtgagtagtataaggaaacggagatcaaacacaaagcaatacttaaaaaaattacctgccacatttctaaaatcttaacaatagcattcactaatgttttttggttttcctttgtgctttctccatagccccttattattattattatcattgacatttgactgacaattttccatttgttttcaaatgaccaagcagattttccaattttctagttaattcctgtgtttccttcaccattctattttctggttttcttttgggctaccgtcttcttcttcttcttcttcttcttcttcttcttcttcttcttcttcttcttcttcttcttcttcttcttcttcttcttcttcttcttcttcttcctcttcttcttatccttttccttcttctgcttctgcttcttcttttcttctttttcttacttcttatatttgatgcactgatttcttctaatgttttgtaacttgggtattaaaaggtgtaatttaaaatgagaaagcagtttctacagaatccttagaaatatgtcgttataagcccccattttcattatattctaaggagctcaaagatatacttttgattcttttctaaactgtgcattcgagagttaatctcttcttgtttacttttatgttcattctttcaatgttattttctaatttttgtgtatcattttatcaacatataaatatatatattcacataagtatacgagttatatatacatgtatttatgaatggcagctgaaacacacattagtgctaatattggtgactaaaagttggagaaccagacattatgtacctcataaagcgaagcaatggaaagtgcacaagcccacctatcaaattgtcttcttaaaagatttgaagctgaatctaagtgagcctctacttgtaactaccagtttacaagaaatagagtagatgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgtttaaaaaaaaaaaacccaggatgtataacacaaagagcaaactgtaatgtaaactgtggactttagttaacaataatgtattgataattactggtttaccagttgtaacaaatgcaccacgctgatgcaagatgttaataatagggaaaattgtaagagagggagagtgatggagtttatggaaattctatctattctgatcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaagttaatattagatcatatttatgatctattaccaatttgttaacaataggtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggatgtggtagtgcacgcctgtaatcccagctacccgggaggctgaggcaggagaatcgcttgaacctggaaggtggaggttacagtgaagcaagatcacaccactgcagtctcaaaaacaaaaagtgtttattgaaatttttaaacttacaagtgctgtgacatttaaataaatcattttctctacatacacggtttttgcacttatacatgtctagacaccctaggaatggtggtgccgtggtgtgaacatggagcctggaatggccagccccaaaacctcctcctcatcaactgttgactcatcaacagtcagtcagtaatcataacttccttaaaatacaagagccgcaaaactttccgggatatctgtgctacttaatctggcagttcctactgtgtcttgcccccggtgtgacgtgctctcttccatgaaattaataactgcaaactgtaatgggaacaaggcaattgtctccgcactcttacccaaagcgttctctgagatgtttggtagttatttgggtccttacttgaccttcgtggccttaaaacaaagggaacatggcatttgtgaatctgaaagacttgtgataattttctcatttcctccaggctgtgtgcctcactctgagtttgcggagggatcagccctttttcagggcgccctcatgtcctgagtatcatcctcagaatgtgaggcttgggcccaatctgaagagggtgtgagggagagccaaaatgcagggattgtcccacaatgcagtcccgctctgtaaatcccttcctctgactagcttgatttcaggctctgagaatggatggggtgggatcgtgaaagggtggcctgtccctccacacctgtgggcgtttctcgtcgggtgggacgagagactgagaaaagagacagagacaaagtatagagaaagaaaagtgggcccaggggaccggtgttcagcttacggaggacccgcgcagcccgggtctctgagttccctcagtatttattgatcattatctctaccatctcggagagggggatgtggcaggacaacagggtagtggtggggaaagggtcagcaggaaaacatgtgaacaaatgtctctgtatcatatacaaggttaagaaaaaagtgctgtgctttgatgtgcacatacataaacatctcagtgcattaaagagcagtattgcaggcagcatgtctcacctccagccgtaaggcggttttctcctatctcagtagatagaatatacaatcgggttttacaccaagacattccattgcccagggaggagcaggagacagatgccttcctcttatctcaactgcaaagaggacttcctcttttactaatcctcctcagcacagaccctttacggctgtccggctgggggacggtcaggtctttcccttcccaccaggccatatttcagaatagtacatggggagaaatcttggacaatacctggctttcctaggcagaggtccctgcggccttccacagtgttttgtgtccctgggtacttgagattagggagtggtgatgagttttaacaagcatgctgccttcaagcatttgtttaacaaacacatcctgcatatccctaaatccattaaaccttgagtcgacacagcacatgtttctgcgagcacagggttgggggtagggttacagattaacagcatctcaaggcaaaagaatttttcttagtacagaacaaaatggagtctctttgtctacttcttccgacatagacacagtaacagtctgatctctctttcttttccccacagattgcttttcagtactttctgctgagacatttttgtatattcatttctctctcaaggagcctctataacaaaagagaaaaaagtatctcggtttctgtgtgtggcacatgagtttgaaggatttctgagactgtcgttcaggactggcgttacagattaaacgccaataagattcaggaccagggacgatgggatccctgacaggcggatataactcctcgttaaggacagactgcccaccactctccttctttctctgtttctgaatttattttctataaattccgctgggtatcagaaccttccttcggctgactgacgctttgcgatttcctctccaagcccggatctgttccccaaaagtctctcgttcctgcttctagcttctctttttagcttctctaggttcgcgtcatcggctttccttttttccgaggttgaatccccagttacaagaagccgagaggtcttcttgtcataaaattaacttccctcggctcctgtaacagggagtgggagcccaccctcccactcgccgtgtagcactctgcatctctgagaagaaagtgaccaccccagcccagcacagcacagattttctttgagcacctgctcggagttcctgtccctcgtcgctccttggttttccctcatcgactacatacagtctgttggatgtcggtcaaggtatcgccagcccctgccatgggaaccatttggggaaaaatagatccgatttattatacttcaaagatgcccaatgattccctgtcgtctgtgtaccataaaaataaaaacagataaaaataagatcaatgtattcgacatctacacccaggcgtacagctctgaggtgatcaactgggaagcgaaggtagcccacccagagggaagaaaggaacaaagctggagaatgcagacgtggatcctgcaggccgctgcctcccaagtgagcgggttacaaattccgctaaccccagccccccaccacgctattggctatttgaggcatgtggggtttttttccggactagaagtcttgtgttccacctggattttcgggaccactcaacattcctgagctccacccctgccaaggtggagccagcacaggactgcaggcggagtctccagactcatccagaaacagccactgcgcggagccgggagcgcgtgtcgaaagcgcacccctagacagctactgtgggaaagctctgggccggacacaattccacatgcttgatattttagaaaagaaggaattataccctagctgtaaagggagtgtggattacagctataacaagtaccaggaaggtaagctttccttgcaaaagctgccctctctgaggctcgaactcaggaccttcagattatgagactgacgcgctgcccgctgcgctaagagggcgacgaagtataatgccgcgccagcttccacaggaatttcctaatttctttccccaggtgggctattttgggacttcagttttcttcgcccagggtcgctagttctccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctttcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaatactctattaaatactttattcccataatttcatttagtcctatttatttatttatttatttatttgccataaatctatacatcattatccccatcttactgatgaaactgaggctcagcagaactaaatccacagctgataaggggtaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacttgccatgtacccgacatttatgttctagatttccaaggcatccttggccctttatccctcacatccctacaaacaccttaaatcattagttctcgaagtgcggtgcccagacccaccacataattctcgaggacacattccatttcaggtactgtcctacccgaaggctttgaggattcagaagaaattgagccatccctgacctcaggagctgacaggacaaactgtcctatctggtccagttcctatactctcaaacttccggattcttataaatgcattttcctaaatattttattttgatactgtaactcttccgctctgtactagtttgctagggctgccataataaatatcacagactgagtggcttaaccaacagaaaattttctcagttctggatgctagaagagttgttagctttggtttctcctgaggcctctctccttggctcgcagatggtcacttaccttcttgctgtattcttgcatggtctctctctctctacacatatttccatcttttcttataagaacgcctattgggatttagggtttcgacatgaatttggtaacgggtggggcaggacaaaattccaccgtaacaggctcaaagttgtttaaatttccaccttcagatttgcagtagactttgttactggaaagcactacttccttttttttttttttttaacaagtattttagagtcccttaattgaacagaccatatacctttccttacctaggaattcccactccaatgcgcggtccacacacccattatttctcctcatcttcattcttcaaggcccattcttgattctttcattcttatttgaaagaatgtagcatggaggaatgtagcatactagtttttccctcggaattgcatgactcattgtcagtaactatcttatggtttttgctgttatgacatttagtatggatgtgtgctatctttcattaatatcctccatcttgtagtcactgtttccataaggaagcgcagccagtg

SEQ ID NO: 176 - DNA, 50169 bp, Homo sapiens
ggttcttttaaaattcctttgatttttttttttttttttggcctgtttttcaagtgtccaatttttgtcacccttctcccatcaggtcagagagatagccaatggtcagaagcaatcttccagcaactgccatagcgctttctcctgcctgcagatgcctctttttagtcagcctttatgggaagtagcagcaccatccgttcccagagagcaagctctggagtagctgagctaaccccagttgctaatctgagctaatcccagttaccccagtggatttacagattgagggtagaacccagcagggttctcttcttggaaagaataggcttccctctaaggtttcacatagatactgggtgaggaaacagccctaaatggcttcagaaattgaatgttctttgggcaaagcaggaagccctgctgtggaagagcatcatttgagcataaatcaggttatcaggacaaacagagtgttcaggaggtctagatggttaagcagagagcctcatcagaatatccgtggtgaagagaaacaatcttgctgggagaaggataaccgtaactggggacttagaataaaggctaaaaatgattcaaagagaatgcaaaaagaatcaggcacaaatctttactatattctgttgtgcaaatctcaccttactatgtgtttatattctattcctccacaatctttattttatttttatgttcacagagacttgctggttccaactaaatgagcacaacagccagtgacaacagaactgcacttaaatagtccctcatcagctcttgagagcagattccttaaaggtgaacaatattccacatacaaggacttttcagcagtatgcattagaaatggaactgaatgtttattattctttatataagttggttgatacgacttttcagcttccctcagtaacattatctaaattttgtagatgacagtaaagctcagaggagttaaaccattttcctcaaatcacgtagctttaaacaggaaaaccagatatgaaaagcagatttctttctaaattaaaaaacaaaaacaaaaaaacttgagctcttgctttaccctagcacatagtctcgccatctgttttctccacaccaggtcattcatgtaacattcattcacataacaaatacaaataaatgagcggattcattcatcagatattaattcagaatctcttttgtgtctaccacactaggctcaagacgtcccagtgtctttgtctcctctccctcaaatctctccacccaatatcttgacaaataaagtagatccttcctgtacaacgtctccagaatcttttcttccttttctttcacctctgtcatcattcatgctacagtgtttacggaggatgtgttctgcagcatgaagtgtcgtgggcactagctctgcagaaagacttctgctgtccacctcaggtgctgacatgataaatgtgggtaaacctcaatcctttaatatctttatgacttctttccctttctccccagttcctgttttctcatgttcaagctctgacattcaaaactaaacacctttctctaacatgttgctttaattatttaagcattctgcctgggatattttcagttagtcatgggatttttcataaaactctcccaatatatctccaagtggccaggcttttcaatcactgcttccctccatgtgtatttcacacacacacacacacacacacacacacactctccacttaaattgaacaggtttatttctttacacaagaattcttacaaacagcccggttttctccaccatatgtccactccttctctgcatagctcaattttgattcttacactatattttacatattcttacactctgatacgatcttgtctcttattctttatggctctgctctgtaattttgttgttgttgttctgaaatatagttggacatgtaacttgtacatgacacaccttagcaaggaggcaactcatatctcagatgtaagtgaaagaagcactctccaggggtttcctatgggagtggtcagcacgctggcctcattggtggaatggcctagttacgaaaacagcaggagctttttgccttccagaaatctggaccatctcacaacccccagacagtctcagctacaaggaaaagtgataattccatcccacttttataaacacacacaaacacacacacacacacacacacacacacacacacacaatcatttaatcatttttaatcatttaatcatttttttaaaatctctgacactttagctgggcaggtctagacatgtcctcctttgctgggatgtgcctttttctgtcccggaataccctaaacttgacattttggcagcacgagttttccctttgtgactttctccttgttccctttctcctccttctttgcagagaatgagtagccactgcgccttgccctgggccatcagtgagaagacctgctcttagtagagccctgctttcccgctgaaggccttgaaatcccctgtgttccaggacacccactaaagatcaagaaagctcccctgacgtggggaattagctcaagcggtagagcgcttgcttagcatgcaagaggtagtgggatcgatgcccacattctccaagctttattatttggaccttgggtctccaaacactcaagtatccaaacccaagttagtgtctgagagcaggatgctgctttggttcaagacataggagcagcaacaatacaggcctggtgatggctccctcctggcattcagtatagtgtagatctactgtgtaattcatttgctgtttcctcaaggagctgtgaaaccaagggacatatacaactgctcttttctccctgtttctgcctgcagcttggtcctaaacctcagacaatcgtgaaatgtgcagggcagagccacctgggtaaacacagcctcggctttctgctcaggggactgaaaccaggatgtgtcaagtaactagaatgtgcctggacagatactgtagaaagcaaacccataaagttgttcatgagcttgtggacacacctgccagctgtgaataagtggctctaatcccaaacaacttacctacaaagagcctgagagctgaactgcgcaatggcccactttccagtcctcactgaagttgcacacactccggaaatctctgaacagtggcgtaaaggctttgcaaatagagttatctttgaaacaacaacacgtggaaggctggttggtacttggaacttgaatacaaggcaattttgtgcctgcaaaaacaaaaatagcaatattattcttaagatttcaacaaaacacagtgtctcatcacataatccaaagaagtccaggttacaagccccaaaatcttcggcattatgaaaaaaacagggagatcttcattcacatggcaaagagactcctcgaataacaatactgagaggacacagatgtcaaaatcatctgacgcatacagtggagcagttatgataacaatgctcctagaattaggggataacattcgtgaagtgaatggaaagttggaaagtctcagcaaatatctggaatatataaacaccaattttaagcttaagaatttaaaaaaatgtattaaccaaaactcttaggggaaataaaaagcttaactggatgatctcgataacagaatgcagatgactaagaaaaagtcaacgaacttgaaaacagaacaagaatacctacataatctgagctatagagagaaaggagtatttctgtaaatgaacagaggctcagggacaaattaaaaaatagcaaatctaacattcacattattgtaatctgaaaagaagaggacaaagaggtctttgtgggataaaactttgaagaattaatggctgaaaatgtatcaaatttgtcaaaagatataaaccaggtttttaaagttcagcaaaggtcaagcaggataaacccaaagaaacccaacccatttcaagacgtatcataatcaaactgctgaaaacgaggaaagtacaaaacaatcttgaaagcagtcaaaggaaaatgaaaaagaaactaccatatgaatgagtgtagatttctcatcaggaaccatagcggccagaaaaaaatgtcataatgttcagtaagtaacaaaagaaaaagacctatcaacccagaatgctatgtggagcaaaagtatctttcagacataaaggcaaataaatgcattctcattggaaggtaagtcaatacattctcattcttagcaagaatgctggaaaagaattagcaaagatttgagataagaaaagtgataccagaaggaaacttagaacatcgtcaatgaaggaacgaaagcagaaatagaaaatgtctgggtagacataacagactgttcttcttctcctgagttccttaaggtatgtttgatgattgaaagccaaaattgtaactttatcagaagcagttgtcattgtatcgagatgtactacatagataagataaaagggtaagtgtaatgggcctaactcttgatgaagtttctatattcaacttgaatggtaaaatattgattctaagtatactgtgaaaagttatatacgtatatggtaatccctagaccacttactaaccagattgaaataaaccaaaacaagatagacagaggaacatagaagaattaaaacaaagggaacaaaggttaatacattattaaatagatctatctaaaaacttatctatattaacattacacgtaaatgatctaaatccttaattaaaaactagagatcatcagaatgtattaaaagtaaatatgctgactgtaagaaagccacctgcaatacacttatatatcagaataaaagttatatagcagattgaaggaaaagagtgggaaagatacctcatgcaagcattaatcaaagacagctgtggtgtatacattaaaatcagacaaagtagatttgaaagcagagaaacttttcaggaataatgaaggctgctagataattacgaatgtccattctccagggaatactgttccaaatgtatatgaggacacagattttcaaaactcataaacaaaattagataagccaggtaaaaatagaaatatccaattttagttgaagacactaaaactcctctctcagtcattggtagacttagtagacaacaaatcagccaacatattggagaactgaaccacaccatccaccaatggatctgatcaacttcataacgcaaaataaaaatttagccagaaagcaaagacaaaaattaaaagaaaagtaagatcatgttataaccaggaaattaagagtggtccatcatatagaagggtgctattattgaaagagtttgaaatagtgacttagttattttgaaagagttttgaaggcattatttagctggaaatgacagaaagactgaaaatggtgaatctggaggtggatcttccctcatctatatttatcttgttttcttttgaggtctagggtgtctatacttcctctgaattacctgatcctactacagtgtctggcacagagcatctccccagtgaatatgtactaaatgagtggaaagtaattgatagattcaaaagagttgtgcaagaataatgttcattatttggcaaatcattgaatgtggtgtttgatggaagacaatgaatcaaagttgacttgaaaggtaagcccaaggccagacgtggtggctcatttctgtaatcccagcactttgggaggccgaggtgggcagatcccttgacgccaggagtttgagaccagcctgggcaacccagtgaaatcctgtctctacaaaaaaaaacaaaaattagccgggtgtggtggtatgcatctgtagttccagctactcaggaggctgaggtgggagcatcactggaacccgggaggcggaggttgcagtgaacagagatcacaccagtgccctggcagtaaagtgacaccttgtcttaaaatgaaatgaaatgaaatgaaataaaataaaataaaataaataaaataaaataaaataaaataaaataaaatataaaagttaagcccaggccgggcgcagtggctcgcacctgtaatcccagcactttgggagaccaaggcaggcagatcacctgaggtcaggagtttgagaccagcctggccaacatggtggaaccccgtctctactaaaaattcaaaaactagcggggcacctgtagtcctagctactcgggaggctgaggcagaagaatcacttgaacccaggaggcagaggttgcagtgagccaagattgtgccactacactgcagcctgggcaacagagtgagactccaactcaaaaaaatttttaaaaaaaatttttaaaaagttaagcccaaaaggtaagtaaagaggaggtctggaattagatatttggtgtatgagtgaatgagctaaagtgcaaaagaatgggcagaataaccgtgagctggagcagagggaaaaaaatcacatgcaaaatctaaaaatatctgcttctcaattcgggctttcccacttagcagctttggcatttaaaaaaaaaaaaaaaaaaaaaaaaacacttgaccgggcacggtggctcacgcctgtaatcccagcactttgggaggccgaggcgggcggatcaggaggtcaagagatagagaccattctggctaacacggtgaaaccctgtctctactgaaaaaatacaaaaaaattagccgggcatggtggcgggtgcctgtagtcccagctactcgggaggctgaggcaggagaatggcctgaacctgggaggcggagcttgcagtgagcccagatcgggccactgcactccagcctgggagacagagcgagactccgtctcacagaacaaacaaacaacaaacaacaacaacaaaaacgcacttagcctatctgattctctattacttctaaaaagtgcatactaaggcataattttgttggcaaaagtcaatcagactacatcaagtaaactccctaagtctcctagtataattcacggcacaaaaatatgaggaaaaacagggaggatatgattaaaagtttagtttgtattttttgttgagtgaatgtctccagtcatagagatgcaagtgtagatacacagtaagagtagtatgaatggcagacaccttggaaggctatttcttccttcattcattcagttggtcactcaatgaactatcatgaattgagcactacctctgtttcttatcaacaaaggagactacggaaaggaagaatgactaagatctctgaagaagggaaaagctagatgactgggccacaagaggaaaaaaagcagcaagacaggtacaattgtgtctagtccctcaagccagaaggtcctatcattatgtgaatactggaaacgggtggactccacctgtcctgagtggggaattcttccagtgcagcattgactgataaggagtgatttccaagtagcattgattgtgttctttaaaagctaggaattgataaagcagcagtgcgtgggaaatgagatttaataatctggatgtcacctcttaggaacagttgctctcttagagcagcaggccacctgtcaatctcgtattctgaaggtcctgagtttgaacatgagacaaggcacagcttatgccgctatttccattaagagaaatgaaataggtgtgataaataatggaacacaaatgctatgagataatgatttcaagacagaccaaatattagcttaaaatttaaaagtgagttttcttttcttttctttctttctttttctctttctttctttctttctttctttctttctttctttctttctttctttctttcttccttgcttccttccttccttctttccttccttccttccttccttctttcctttcctttctctgtctgtctttatttattttttccttcttttggcttctcagtcgcttgagtacaaggcgtggtgaaggcatataaattacaccagaaactgcaagctatgtcttatgtctacctctctagctgacaggggaggcaggggaaatttctcttccaattgcctgctctgaaggtcatccaaacataattatggggtggggtgggtaaagtcttttattcttttaatcgtccaaccgatagttctcaacacatatcttgttaagagactgttttgggtatagcaattcgcagtgaataaaatacagatattctcacctttgtgatactacgtcaatgttggggggagtggggagaaagagacagaagcaaaaaagaaaaataaacaagaagtcatgtgatattatctactgggagggagtcattaggcagtaaaggactcggcagtgtggaggtgacacattcacttttcaggagaagaatcagggaagttgtcaccttgaagatatcatttagcttccctttcttccaatagtctttctttacatgggaaatgaggactctaggattctccggctggatctcagcacctagagatggatctgggcaataggaactgctcagtaagcattacctactgctttggttgccttctccctggcctcttggattgagcttgcatcatacgtgttcagtaggaacttgcttagtggatttacaggttgaggttagaactcaccgggattctcttcctggagagaacaggcttccctctaaggtttcatatagaccccgggtgaggaaagagccctaaatggcttgaaaaattgaatgctctttgggcaaagcaagaagcgccactatggaagggcatcatttgggcctatatcagggtctcagtacaaagatgagtgctcacgtggtcaagatggttaagcagagaatctgaccagaatgttcacggtgcaaagaaataatcttgttgggagaaggatcacaacaattggggaattagaatacaggctaaatgagactcaaaaataatacaacaagaatcaggcacaaatcctttactactacattcttttgtacaaatccattttgcctagaaaatcataccttactatgcatccctattgtgtttctccaccatctattttactttttaaactttatttcatttttatcatcacagaagcttattgctacaaaacaaatgagcaaatcagccaatggcaacaaaactgcactgatctctctccttagaccttcagaacattttccttaaaggtgaacaatactccacgttcaagaatttttcagctctatgtgctagaaactatactgactgtttattaatttttatgtaagttggtcgatatagtttttcagcttccccaagtattattaccctagtgttacagatgacactgaagctcagagcagttaaaccattttccttagatcacataactttaaagagggaaaccagatatgagaagcagatttctttctcaatgaaaaaaatcacaagctcttcttgctttagtctagcacatagtcttatcatctattttcttcacaccagctcactcatgtaacattcattcatttaccaaatacagataaatgagtggatttattcttgcatcgatcagatatgaattcaaaatctcttctgtgtctgccacaccgggctcaagacttgccagtgcctttgtctcctctccctcaaatctctccacccaatgtcttgacaaatactgtagatccttcctgcataaactctgcagaatctttttcttctgttttactcacctccttctttatccatgctatgatgttcatggaggatgttttcttcaccatgaagtgtgaaggggattgaagctgcagaaagactcatgctgttcacctcaggaactgacacagtcaatgtggataaatctcaatcctttaatatctttatgacttctttctctttctccccagatccagtttttccattttcaagttctttgacatttaaaactaaaaacctttccctaaaatgctgcttttctacctggaattttttcaatgagtctttagcttttataatattctcccaacatatctccaagcatccaggcttttcaatcactacttccctccgtgtatattttacacacacacacacacacacacacacacacacactccacttaaattgaacaggcatatttctttacacaggaattcctacaaacattccaccctatacctaccctaggttttctccaccctatgtccactctttctctgcattgctgaatgtgttttctttattctttcactctgatatgatctttgtctcttattctttatgcctcttatctgcatttttttgttattattgttctgccatgcagttggatatgtaacttttacatgacacaccttagcaagaagacaacacatgtctcagatgtaagtaagaaaaacactctccagggatttcctggtgtagtgctcagcaccctggcctcattcctgaaagtccctcggtgtggaaaaagcaggagctctttgccttccagaaatctgcatcatcccacagcctcagctacaagaaacaagtgacaatgccatctcttttcttttaaaaaaatcatttaagcttcctgagatatctgtgacacattagctgggcagggtccttctgtgggacatgtcattttccgtctcggaatatgtgaaacttgacattttggcaacaccagagttttccctttgtgactttctccttgttcccttttctcctccctcctcacagagaataagtacccactgcactcttgccctgggccatcaatgagaagatctgctcttagtggagccctgctttcgcggtgaaggccttgaagtcgcgtgtgttctagactgcccactaaggatgaaaaaagatgctgtgagatgaagaagtagctcaagtggtggagtgctcgcttagcatgtgagaggtagtgggattgatgcccacattctccaggtttcactagtcggacctcaggtctccaggttacagtggaaaaaaatatgtgttagacactgatctcagaaaacagtaagttagacactcatctcagtagcagcctggacacttctttggctcattatgtaagggcagcaacaatacgggcttgactaagattctactggtatgtggtatagtatagatctatcgatgtgtaattagttttctgtttctttgaggagctgtgatacaaagggacatatccagttgcacttattctccctgtttcctcctgcagcttggtcctaaatgcagcataattatggaaagcgcagggcagagccactcaggtaaatacagccccagctttctgatcgggagaccgaaactaggagttgccaagtaaccaggaaagacactgtggagagcaaacctgtcaagttgtatgtgaactcctggatgcgcctgtgagctgtgaataagtggctctgatcaaagacaacttatctaaaaagagcctgagaatcgaactaagtgatagcctactttccagtcctcactggccactgggttgcacatactccagagtctctgaatagcagtgttaaggctttgaaaatagaatcgactttgaaactacaacacacaaggctggctggttattggaacttgaacacaaggcaatcacatgcctgcaaaaacaaaaatagcaatattatccttaagatttcaacaagacacagtgtctcatcacataatgcaaagtacaaccccaaaatattcagcatatgaagaaccagggcaatcttaattcacttggcaaagagaatcctcgaataacaatactgagaagacacagatgttacaatcatctgacacatacttttaagcagttattacaacaatgctccatgaatgaaaggataacactcttgaagtgaatggaaagttgggaagtcttagcaagtatctggaagctctaaacactgattttaaacttaaaaattaaaaaatgtattcatcaaaactattaggagaaaaaaaacttcaatgggttatttcaataacaaaattgagacactcagaataaagtcaatgaacttgaaaacagaacaaaaataccaacctaacctgaacaatagagaaaaaggagtgcttttgcaaatgaacagagcctcccggacaaacagaaaaataagaaaaatctaacacatcattgtaatcctgcaggaagaagagaaagaggtcctccagaaagaaaactccgaagaattaatggctgaaaacatatcaaatttatcaaaacactttagaagttcaataaatgtcaagtaggttaaacccaaagaaatccatacccagacacatcataatcaaactgctgaaaactaaggaaaaccataaaaatcttgaaggcagccaaatgaaaataaaagggaaactgccacttgaatgactgtggacttctcatcagaaaccataggggcccaaggaaacatttactaaataccaaaagaaaagacctgtcaacccagaatgctatgtagagcaaaaatatctttcagactaaaggtaaataaatacattctcacaggaaggtaaactgagagaattcattgctggtagaactgctggacaagaattagcaacgatttaagatgagaaaaatgataccagaaagagacaggacaccatcagtgaaggaacgaaagccgaaatagaaaatgtctgggtagacattacagactattattcttctcttgagttccttaaggtatgtttcatgattgaaagcaaaaattgtaactttatctgatgcagttgccattgtatctagatgtgctacatacataacataaaagggtaaaggtaaagggcctaactgctgatgaagtttctatattcaacttgaatggtaaaatattgattctacgtatactgtgaaaggttatatatgtatatggtgatccctagaccacttaggaaccagatttaaataaaccaaaataaactaggaagaagaacatagaagaattaagacaaggggaacaaatgattaataaattattaaaaagtagatctatcggctgggcacggcgtctcacgcctgtaatcccagcactttgggaggccgaggtggctggatcacctgatgtcaggagtttgagaccagcctggccagcatggtgaaaccctgtctctactaaaaatacaaaaaattagccaggcatgaagccgggtgcctgtaatcccagctacttgggaggctgagacaggagaatcacttgaacctgggaggcagaggttgcagtgaggggagattgcaccatggcactccagcctgggtggcaagagcaagactccatctcagaaagaaaaacaatagatctacctaaaaacttatctataaaaacattaaatgtaaatgatctaaaacaatgaattgaaaaccagaaattgtcagaatgtattataaatgaatatgctgactacaggaaagtcactagtaatatacttatatgtgagattaaaagttatatagcatattgaaagtaaagaatgggaaaagatatgtcatttaggcattactcaaagaaagctgtggtggatatattcaaatcagacaaaccagattttaaattgtagaaaacttccagggataaagggggctgttacataattagaggtgccaacacaccagagaaataatgtcccaaatgcatataaggacacagggcttcaaaactcgtaagcaaaattggataatccagataaaaatagaaaaatccaattacatttgcagacgttaacagtcccctctcagtaactgatagatccagtagacaataaatcagtaaacacatttgagacccgaacaacatccatacagcaatggatctaatcaatcaactttctacagcaaaatcacaatttgggtagaaagaagagaaaaaaaataaaagaaaaacaagatcatgctataactaggaaatcaggaatgttcagggtgcaaaagagtgatatattgaaactgacatttttgaaagggttatttagctgtaaatgacatgacacggagactgaaatcgtaaaactggacgtggatcttcccttctccatatttgtcctgccttctcttgaggtctgggctgcttgaatctttagaatctcctgaacttaccacagtgtctggcacagagcatcttccctgtgaatgtgtactgaatcaatggaaaggaattgacaggttcaaaaatgttgtgcaggaataatgtttactatttcacaaatcactggatgtggtgtttgaaggagaaaaatgtgtcaaaagttgacttggaaacaaagcccaaaaggtaagtgaaggggatttggggaatgagatatttggtgtgtgaatgaatggggtgctgtggagaggagtagggagtaagattgtgaactggagcagagaaagaatcacgttttaaaatctaaaacatcttctcctcagttcaagctttgacacttagcagctctggcaccttggaaacaaaacttatctgaggttccattacttctagaaagtccagattaggacacatagttttgttggtgaaactctgttggactacatgaagtaaattcaataaatctcttagtataattaatggcatacaagatttgctttacactttttgtagcaggattgtctccagtcgtgtagatgcaagaggagatagagagtaagacacagtagtatggacaggagacacctttaaagactattttttcattccttcattcgttcagttggtcagtcagtgaactattatggactgaacatgtcctgtgtgtcttttcaaaaaaggacaccataggaggtgtaagagtgattaagatctctgaaggagggagaagtcagatcactgggccacaagagggaaaaagtcagcaaaacaggtacaattgttcttggcctcttgcctcaagatggtcgtcttgttagatgaatactagaaatgggtagattccacctgtcctgaggataaaattctttgggtgcaggattggctgataaagagtgatttccaagcaccattgattgtgttctttgaaagttaggaactgataaagcagcagtgcttgggaaaatagcacgtgggatgtcaattcttgggtgagaaccgccctctttctgcagcaggccacacatcaatctcataatctaaaggttttgagtttgaacatcagagaggatacagtttttgctgctatttcagttgagggaaacaaaatgggtgcactaaataatgaaatgcaaatgctatgagataacagtttgaagactgactcaacattagcttagaatggaaaagtgatttcggttttttggagtttttttgttgttgtttgtttgttttttggcttgtcagtggtttgagtaaaatgagtggtaaagggatatagattacagaagaaactgcaagctatatcatataattggtctttctcactagctgatggaagaaacaggaaattttttgtcgagctttctgctctcaaggttacccaattgtaattatgaggtgagtgggtgaagtcatttattcttttatcctacatgtatttctcgagcacgtatcttgttaagagactgttcggggtacagccattcaacagtgaaaaaacgcatatattcttcacctttgcgaagctagtttctagttgataggggtgaagagaaacagatcagaagcaaacaagaaaaatacataagatgttatgtgacaacgtctactgggaaggaacccacaggcagtaagggacttgggagtgtggagatggcccattcagaagcttttaggagcggaatctgagaagttgtcaccttgaagacatcctttacccaccctccaccccctccccactccccactcctgctccttccttcaatcatctttcttcacgtaggaaatgaggactgtgggattctctggctggatcccagcacctagagagggatctgatcaataagaactgctcagtaagcattacctattgctttggttgccttccccttgcagagtgctggcctcttggattgagcttgcatcataggtgttcagtaggagcttgcttagtggatttacaggttgaggttagaacccaccgggattctcttcctggaaagaacaggcttccctctaaggtttcacatagaccccgagtgaggaaagagccctaaattgcttgaaaaattgattgctctttgggcaaaacaagaaaccctcctatggaagggcatcatttgggcatatatcggggtctcagtacaaagatgagtgctcaagaggtcaagatgcttaagcagagaatttcaccagaatgttcgtggtacagagaaacagtcttgttgggagaaggatgacaattgaggccttggaatataagctaaataagcttcaaaggggatacaaaaaagaatcaggcacaaatcctttactacattattttgtacagctcaatttttgcctagaaaatcataccttactttgcatccctattgtgttcctccaccatctattttgtttttttaagcgttatttcatttttatgttcacagaagcttgttgctacaactaaatgagcaaaacagccagtagcaacagaaatgcgttactatctctcctcagaccttgaaagcattttccttaaaggtgaacaatattccacatacaaggaggttttcagcactatgtgctagaaattatactgaatgtttcttaatttttacgtaagtcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacattaatgtaatagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctggggggcatatagagccactcagagccttagaggtacgttcagtgaaatggagccaatcaccatatagtgtagcctattgttcgtctgaccaaaatgcactatgttgcgatagcatggattctacagacccgtgaagcccatttggaccacaagacactctttccatcatgcctgcacacctatccttcactcttcattggctcatgcagacttttgaaagtatttagcaataagcatcctacccccaagaagcttatggtctcatggagaagatggccaagcaacagacaatcccaacatggtgaatgccgctaaaacaaatgcgtacctggatctccgtgagtgctaggaggaaagcaacccaaactcagaaaagtaggagaggtgtcagggaagacattttccagaagatggtttcgtgtctaacaaagccgtgagacgagcaaagaggaggtgaaaggctcagcgttctatggggacatttccttaagtccagtatctctagagttgagtgagggaagctaaaagagaggaaatagaaatgaaaaatgggagttcttgagaggctttacttaccctgcacaagccaaggacaggtctgcgggaagtaagcagatgcacagttaggaaagcccatatcaggagttagtcacgacagagaaagatttgtacactttggaaatcgtaaaagaatgaaaagcccaggtccttatttccctgttttcgtctctgtttttcacgttcctcccggatttcaatttctttctggaatcttagctctcttcgtcatctgctcttgcaggaacactgaactgcaaacgcaaccctacgattcagcgaactacgtcctatcaaggttactgggtacaaatacatttactttcgtgagttctcttgtgactttctgtatcactgcccacagttgctactgtgagacaagcattagaagtctgtgtagattgctgggttcacacacatttacattctttttctcttgtgagctttgacgtggctacacataattgttactgtgaaataaacattagaaaagcctgtggcccgtgaaataaacattagaaaagcctgtggcccgtacggggatcgaacccgcgaccttggcgttattagcaccacgctctgaccaactgagctaaccggccccgccggcggaacggaccctacctctcttgagaagtttaaaggcgaacgttattccaatcaccaaagaaacttttctgaagttcttggagttggaaagaacctacgatctttgctaacttggttacgatcctcggcaaatttcttctaacctggaaatttcagttaaaatacaattctgcggaaggaaagttcaaatgtcacctgcttcagtgtttcacgacaaagggtttcagtgaccacccttttaaacgcaacgccatcaccgtccgccggtactgtggcctgtccctatcactcctttctactttgcttccgtagcttctgagcgacccgtgaagaaattgacggaaaacggaaggaattgccgccagttcctttccacgggccgtcaaggccagtataagtccccacccaggctcctctgctcgtaacttctagcacgattcccactgaattcgcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacatttcgaataactgaataaaggaaatctcaaccaacccccttgccgtattacaggtggtccagctctctgcctagactattgtgctaatgtcctgttccttctcccggcttttgaactagattctcacctctctccaatccatctttcgcagggctggcctgtctttccgcctcacttctgaaattctatccattgcagcctctatgcaaaccgactctggttaatacttcagtcggtatggctcccctcttccgcactttgcactgcgagaaatgcccttccttgaggcagctggaggcctcctcctcctgagagcttaattgtggacacagtcttgagtagaggcgaaaaggaaagaaggctgggagataatgggggaaaagcacacctttggtctggtttgaaagctggcgcccgaaaaggggagcgaaaggacaagaaaaaaaaacacgctccgaaagtgtctgagattgctgcggccataaagcagagcactaaccgcggtactgataagggaggggagcagggctccgccgccgggcctgtgcccatggatctaggtgaggacgggcactccttcctccgcggccaaatgttgcatttcccaagaccaccctggcccgccacgcccccatcctgtgcctataaaaactcccgagaccctagcgggcacggacacaagcggctggacgtgaagaggaacacaccggcgggagaacacagaacacccaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgagctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaaaaacaaaaaaaaacaagtgttctagatttgcagaggaccttttcggagctaagttccagtagctatactgtaagttgatttcttgggcagttctgttggtgaggaaagagggcaaattgagaaatgaacaaacacagaagttgcaaaagccctgtgacttacagcacaggacgagtctacaaaccctgccataccacactaagctcaaattgttttaacaccagcttactcagacccgatgatccaagataagaccaaagccaaacggatccagcaactctgcgcagatcttcatgttccagcagctaagttccactgaataaacctatgattcgcctagtttagaaattctggccgtgcgcggtggctcacgtctgtaatcccagcactttcggaggccgaggcgggcggatcacaaggtcaggagaccgagaccatcctggctaacacggtgaaactccgtctctactaaagatacaaaaaaaattagccgggcgtggtggcgggcgcctgtagtcccagctactcgggaggctgaggcaggagaatggcgtgaactcgggaggcggagcttgcagtgagccgagatcgcgccactgcactctagccgggacgacagagcaagactccgtctcaaaaaaaaaaaaaaaaaaaaaaaaagaaaagaaaagaaaagaaaagaaaaagaaaaagaaattctgtccagtccctcctgagaaggaccttactaaccttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcatttttgtcatatgacactacttgtattttacaggattcacttggtctccatctgacctcctcagagtagactgctctttcccaatcactcctgcaattaccctaggagatgtgtgatcctaaagtaagggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaatataaaggcaagtatctttttcactcagttcaccttggttctaagagtgggtctatataaagaaatggagcatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaattaatcatgttataaacaatatgaacataaaagcaaaaattgcaaggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctaatgcatctacaaaaataagcattataagtaaatgcagctatgtcacagattacaatatacaaaaattaattgtatttctatgtactagcatcaaaaaaatggaaaattaaattaccactttcaataggtttaaaacaaatgaaatatttagagataaacttgtcaatgtgcacaagacttgtacctagaaatctactaaagattgctgagaaaaactcaggaaaacctgaataattggtggtgtttgccatatttacagattgagaaatttaatattatttagataactttttttttctctgagttgatctatagatttagtacaatcccaacaaatatcccagcaggagtttttgttttgttttgtttgtttgtttttacagaaattgacaagcttattctgaaggacttagagtaacctaaataattaggaaaagaaaaacaaagttagaggacttacaccaagtaatttcaagacttactataaagctaaggtaatcaaaataatgtggtattgtctcaaggatacttacccagattgatggaatagaatagatagtccagaaatagaccaatgtatgtggtcaactgatttatgacagaggtaaaatgtttttttaaacaaatggtcccaggcaactgagtatggaaaaaatgattccctacccttaactcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaaaataagatgcttatatggccaataaggcacactaaaagatgttcaacaacattaatcagtacaaaaatgcaaattaaatctatcaaggattaataggtaacaacagatctcaactcccctgaatggagaaacaattagtaacacagatactagataagttacttgaaggatcaatcgataaaaagatacttgggcttatttccaggtttgtgttcttaaaaagtgatgcattcaacagagcatttgaggtaactgctaattagggacggtacttccttctctttcatctaatgggagagtgaaatcagattagaactagtgctttcctaatgagatcttttctctctttctcaggatcccgactcagattgaaaaagcagaggatggtcactgccttccaggtctgaggctgtctcccagaaacttcattcctcgcttcgccttggtagggaagttcccggaggtgtttgaaaagctggaaacttaagtgggacatggaacgatatttgtgtcccggttatcaaaacaggcagaaaagacaaatgcggtgtgggggaattggctcaagcggtagagcgcttgcttagcatgcaagaggtagcaggatcgacgcctgcactctccagcttcttttaatccctaggctaccaatggtatctggtaaatactttcagcggatttaccgctctttatttgactcagtttcatcttgttatgtacattttttttttaaggaaattatacatagcattccatgcaaaagcaaaaaaggaagcgattagtcacaagtgagttttgccaatacaggttttggggcttcagctcgaagttaatacaatgtatttttgtggggaaatcaaactttagccttttgggtacaaaatatgaggaacagcctggaaatagtgtcaggaggcaaaagcaggagacttgaatgtgccaaccttttgcttttattcacattgacaacacatggtcaggtagaggatgaaaacgtgtcttctaccagattatctgagagttggccaggctcccaccttcacttatactccttccttacctctctcctgtgtaggtaagagaggtaaggagagaggtaaggaaggagtataagtgaaggtgggagctagcatattaactctagtggtcggatacactctcactaagaaaagtgacatttattccttctattcatctctctgaaagctcgttctgacaaaaatgtgctcaaaataaatggggacctaggtcttcctctaatttccaagatgaaccaaaacgtaaaaaaatgtatttttgaaattgcaacactatcccctatttaaagaaactacatgaggcgctgtattaacaacacatatgttgactagctcaactggcccaagcagagctcagaatgctggagagagtggtctttggatagatgactccaggaagctcttgtaggtccctgggacgtgcccctctttccatccttctttctttcccatcactcaaatctctctctgacaccatttgacttctcagcattgccctttgttaatcgtaatagaaagacaatgttattgattacatgtttttctattttatcttcttattcataaatgatctcaaaaatgaatgtcataaataataaacatgttgttgaatttttgtcccataggagcagcctctttccttctcaggatgtgcactcctaataaactgggaccgtgaaggagggacctgaagctgccccaaaccacctgcagttccatgaaggccatgcctccacccactaatcactctgaaagtagtgcccctccactcttccccaaccacatttccttttcaggcaaaaacatttctatgggtttgttagaccctagcttctaatcctttcttcagtctttactgatctgaagccactctctcctttgaggcttctaaattatctgtatagcctttctccattcagcaaattttcatcaggcaaaaatcctacttgacgctagttatactcagagtaaaataactatgttcctgtcttaaatgagaattcttcacaggtggaaagcagatttggaatccactacaactccaaggcagtggagctaatgtagcctcccctgggctacaggggaagccttcttctgtgggcccgggaattgaagaactagacaggcataagaaggacaagtgtggtgcccaatggagcaagagaaggggggaggaaggtgacagggaagggaaatggcaggagaagcacctacacagcagacacggtatagcctgcatctgtttttccttttggctgagagatccctgagctctgtggtgacaattttccataatttttcatataaaaaatgaagattataaactatttctaggcattttacctgcattactattaatatgtgtacagcatctaaaatagggtctagacggcaattgcacagtactattacttgctattgttgtggcactttctatgtggatcactggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggcgcgtatggcgtgaagttctggggctgggagaagctgccccactacttccgggcggccttgcctgcagggagcaggtgaggatcacagctctagagcgggctgcaatagctgtgcccgcaagccaggcagttccgggtggtgcttctccaactggaacgtgctctctacttccgagagatgaagaaggcgaaattgagaagtgaggagagaggtctccctcatgacctattttggaaatccgtattcttcacactctcaggctcgtagaactttgcccaaggcagtatctgagaagctccgccctcaatcttgtcctgccagggatttggcggcccaaagtaccggcaggctcctgataaccaggaaaatgggtggggggtggtgtatcctcagtggggaattagctcaggcggtagagcgctcgcttagcatgcgagaggtagcgggatcgacgcccgcattctccagttccttgtccggtttatgtctcttggtttgtatacccgcttctttctcctgttgacaacggcggtgcttcttacctgggagaagatcagaggaacctgccccctcccccgatctcgtgttttactgctccccatgtaagagtcttgttgcccctgcttccatcctcccatgttttccactcctgccacaggtttggcacttctagctactcaggtctcaatgcaaatttcccgtctttagacaagtacagctaaaagtgatgcccacacgatctctcaattcctactacatcttcacaaatatcgtctcctccagaaagtatgtctttaagttactggtttgtttttctctcccctagagtgggagcttcctgagtaccgaaacgctgtctatgtacactgtgttcaactcgcttcatccccatgcgtagagttaaggttctgtaaaatacggttactgccttgaacagataaggaaacagggagatcaaagacagagcaatacttaaaaacattatcctgccacatttctcaaatcttaataatagcattcactaatgtttttggtttttctttgtgctttctccatatccccttattattattattattttacatttggctgaccattttacacttctttttcaaatgaccaatcagattttgcaattttctagttaattcctgtgtttccttcaccattctattttctttttttttttctttttctttttttttttcgggcttcttcttcttcttcttcttcttcttcttcttcttcttcttcttcttcttcttcttcttccttcttatatttaatgcactgatttcttctaatgttttgtaacttgggtattaaaaggtgtaatttaaaatgagaaagcagtttctacagagtccttagaaatatgtcattttaagtccccattttcattatattctaaggagctcgaagatatacttttgattcttttctaaactgtgcattcgagagttaatctcttcttgtttacttttacgttcattctttcaatgttattttctaatttttgtgtatcattttgtttatcaacacataaatatgtacattcacataagtatacgagttatatatacatgtatttatgaatggcagctgaaccacacattagtgctaatattggtgactaaaagttggagaaccagacattatgtacctcataaagcgaagcaatggaaagtgcacaagcccacctatcaaattgtcttgttaaaagatttgaagctgaatctaagtgagcctctacttgtaactaccagtttacaagaaatagagtaggtgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgttaaaaaaaaaaaaacccaggatgtataacacaaagagcaaactgtaatgtaaactgtggacttcagttaacaataatgtattagtaattactggtttaccagttgtaacaagtgtaccatactgatgcaagatgttaataatagggaaaattgtaagagaggtagagtgatggagtttatggaaattctatctattctggtcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaaagttaatattagatcatatttatgatctattaccaatttgttaacaacaagtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggacgtggtagcgcacgcctgtaatcccagctactcgggaggctgaggcaggagaatcgcttgaacctggaaggtggaggttacagtggatcgacatcgcaccactgcactctcaaaaaaaaaaaaaaaaaaaaaaaaagtctttattgaaagtttcaaacttaaaagtgctctcacatataaataaaatcattttctctatatacatggtttttgcaagtgtacatgtctagacaccctaggaatggtggtgccgtggtgtgaacgtggagcctggaatggccagccccaaaacctcctcctcatcaactgttgactcgtcaacagtcagtcagtaatcaaaacttccttaaaatacaaagagccgcagaacattccgggatatctgtgctacttaatctggcagttcctactgtgtcttgcccccggtgtgacgtgctctcttccatgaaattaataactgcaaactgtaatgggaacaatgcaattgattgtctccgcactcttgcccaaagcgttctctgagatgtttggtagttatttgggtccttacttgaccttcgtggccttaaaacaaagggaacatggcatttgtgaatctgaaagaattgtgataattttctcatttcctcctggctgtgtgcatcaccctgagtttgcggagggatcagccctttttcagagccccctcacgtcctgagtatcatcctcagaatgtggggcttgggctcaatttgaagagggtgtgagggagagccaaaatgcagggattgtcccacagtgcagtcctgctttgtaaaccccttcctctgactagcttgattttagtctctgagaatggatggggtgggatggcttttcagtactttctgctgagacatttttgtatattcatttctctctcaaggagcctctgtaacaaaagagaaaaaactgtctcgggttctgtgtgtggcacatgagtttgaaggatttctgagactattgttcaggactggcgttacagatgaaatatagattcaggaccagtgacggtgggatccttggcaggcggacataacgcctcgttaaggacagactgcccaccactctctttctttctttctctctttccgaaatcattttctataaattccactgggtatcagaaccttccttaggctgactggcgcttcgcagtctcctctccaagcccggatctattccccaaaattctctcgttcatgcttctagcttctcttcttagcttctctaggttcgcgtcatcggctttccttgtttcccaggttgaatccccagttccaagcggctcctgtaacagggagtgggagcccaccctcccactcgccgtgtagcactctgcatctctgagaagaaagtgaccaccccagcccagcacagattttcttcgtctttgagcacctgctcggagttcccgcccctcgtcgctccttggttttccctcattgcctacatagagtctgttggatgtcggtcaaggtatccccagcccctgccgtgggaaccgtttggggaaaaacagacctgatttatttatacttcaaagatgcccaatgattccctgtcgtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaagtgagcgggttacaaattccgctaaccccagcccgccaccccgctattggctatttgaggcatgtgggggatttttccggactagaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaaggtaagcgttcacttgcaaaagctgccctctctgaggctcgaactcaggaccttcagattatgagactgacgcgctgcccgctgcgctaagagggcgacgaagtgcatcaacgcgccagcttccacaggaatttcctaatttctttccccaggcgggttattttgggacttcagttttcttcgcccaaggtcgctagttttccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctctcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaataccctattaaagattttattcccgtaatttcatttagtccaatttatttatttatttatttgccataaatctatacatcattatccccatcttactgatgaaactgaggctcagcagaactaaatccacagctgataaggggcaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacctgccatgtacccggcatttatgctctagatttccaaggcatccttggccctttatccctcacatccctacaaacaccttaaatcattagttctcgaagtgcggtgcccagacccaccacataattctcgaggacacattccatttcaggtactgtgctacccgaaggctttgaggattcagaggaaattgagccatccctgacctcaggagctgacaggacaaactgtcctatctggtccggttcctatactctcaaacttccggattcttataaatgcatcttcctaaatattttattttgatactgtaactcccattctgcactagtttgctagggctgccataataaatatcatagactgagtgccttaaccaacagaaaattttctcagttctggaggctagaagggttgttagctttggtttctcctgaggcctctctccttggctcgcagatggtcacttaccttcttgctatattctcccacggtctctctctctacacatgtttccatcttttcttataagaactcctattgggagttagggtttcgacatgaatttgatgacaggtggggcgggacaaaattccaccatgacaggctcaaagttgtttacattttcaccctcatatttgcagtagactttgttactggaaaacactacttgcttttttttttttttaacacgtattttaaagccccttaattaaacagaccatatacctttccttatctaggaattcccattccagtgcctggtccacacatccattatttctcctcatctccattcctcaaggcccattcttgattctttcattcttatttgaaagaatgtagcatggaggaatgtagcatactagtttttccctcggaattgcatgactcattgtcatgcaaattacgcagtctcaggtgttccttttagcaacacaaagtagactaaggtgtgtacatttttgtacttgtcaaatgtggttagaataccaaatgaggtactgcctcacagatccctgagatgtcattacttggcataacaaaatcataatatagatatcataataatgcataagcagacaggaaaaaaccataataataacaaaactcattaagggatagccacgtaagtttatcagttagttctctctaaactctgtaatatgaatgtggccaatctctgggatttaataatacaaaaaacatgttttggtctcccagtgtcattttaatcttattcagtaggatatattctttccctatctccatatgaagacatacacagttttatgcctcatcccaggcaatacagtctcagtctcaaagttaagatgctgagctccatgtaacactctaaaatttaaacttgacataaagatcagatctcttcctttacctactgggcctgttgagtcagctaaaactatttggatagttttctaaggaaaatgtttcatctctcttttcttaccctaacattctaccatttgttaaccactgttctgagacttccgtgtttcaatcgtggtggaagatgagttaaagccagggaggggtggtggggagaataataaagttcttacttttaaatggtgttgtcattagccagtgtcatgctttccattcagctgtttgaatacgaataatttttttaatacgatccatgattgtggattctcgtgtgcatttcccttgatgatgatgtactctcctgtacccccttctttatgactgcttttccagccactgcaaaactcaaagcttccttttgcttctttttccttagttacgttcatccttccacatagcccactgggactggctcaaagttgacctcatgctagtgctccctctctcctgattcccacacctgtcttgtgggaaaggcctacatctggttgtccctgaaaagccctgggactacaggccaatcccaatatagaaggaacttcaggcagtcaatctgcccatttctcccctttacatttctcatgcatctaactaccgtatctcccatattttggtgccagtgattgaacttgttggcacctgtattagtccattgtcacactgctataaagaactactggagactgggtaatttatgaagaaaagaggtttcattgacccacagtgccacaggctgtataggaagcatggctgggaggcctcaagaaacttacaatcatggcggaaggcgaaggagaagcaagcatgccttaccatggcagagtcggagagaaagagcaaaggggaaagtgttacacacttttcaacaaccagatctcaggagaactcactcattgtcatgagaacagcatgagggaaatctgtctggaacaggtttgtgaacccattgaggtgttcatccagtgctgtttcagagaaatctctatttcaatctattcctatacattagttactgaaaaacaacagacaatcacaaaaacaagttgacctttttgtgatccttgagcccagttgcgaagggccctcgtgaccgggcctcatgccaaacaactcgttacaaaaagagctagggttccagactgggctgaagcttcatgagacttctcctcgtctgtgcgcagacagctggccaactctggagcccaggctgttgcttcccggtctgttggtgaatcctccatagtctggtgagtgtacatatatatgtatatacatatatatatatatatatatatatatatatatgtctttttccttcccattgcaatttgcttattatatcagtctgcttattatttcatttgcttattatatctgcattgccatttacgtgggataaaggttgtttacccttaaaggtgttgtgtgggtgtcttttcttctccctttacatgtcttccacacagaacatgtacacatgtatctacaggtgcatgtgtgtatgtagaagtgattgcacctgtgtttatgtatacatgtctgtgtacaccacatgcatgtgtaaatgtatgtgggtacacgtgcatgcatgtgtatgcatacatgcatgtacacatgcacaaaggtatctacacatacatgtgtatacatgcatgcatgcatgtttatgtatacatgcatgtacaccgtatgtatgtgtgtatgcatgtgtgtattttcagacgcatatgcatatgcatacatgcatgtacttgcatgtgcacacgtagctgcacattcacgtgtgtatgtatacatgtatgtacacgtgtgtgcatgtgtgagtgtgtaaagatatgtaaacatgtatgtgcaaatgcatgtgggtgtgtgtgcatggatgtaggtgtatccatgtattgtgtacacagtatgcatgcatgtatgtgtgtagatatatgtgcagatagacatgtgctcacacgtctgcatgtatgtgtgtacatgtgtatgtgtttacccacgtacgtgtgtatgcacgtgtgtacgcatgcatgtacatgcgtatgcatgtgtgtatgcatgcatgcacatgcgtatgcatgtgtgtatgcatgcatgcacacatgtatgcataaatgtatgcattgtgcacatgtatgcacatgtttgtatgaatgatgtatatatacatacacgtatacaccatgtataccagcctacaaatgcatctgtgcacacacatgtgaaggcgtgtgtatgcctgaatacaagtgtccatacatacgtgtgcatatccacacatacatgtgtacaacacgcatgtgtgcacacatgcatgtgcacacacaaaaattcgtgtgcaaacacatgcatgcatgacatatatgtgtacatggatatgtgggtatacatgcatgtgcatacacacgtgcacgtgcatgcacacatgcacacataatacatgtatatatacatacatgtttgcgtgaaaagcacgatgcatacatgcacacaaacataaatgtgcatacgcacgtacttgtgcatacaaatgcacatgtgtacccatacatgcattcagacgtttgtgcaatgtatacatacacctataagtacatacacacatatacactcatacatgtttgcacacacgcatacgtacacacatgcacgtgtacaaatacatgtgtgcgtgtgcatgcatttgtgcatattcattgattgtgtgcacaatatgtatgtgtgcatgtatgtgtgtatacgtgtatgtgtagatgcatacgtgtatgttaacatgcatgtacactcatgtaaacatgcatcaacacatttatacacgtatttatttgtgtatcaggtttgtatacacgtacctaaacatgcatgcgagcattcgtgcatgtatgtacacgagaatgcatatgtgtatgcatacgtgtatgtacacatataagcacaggcatctacacgtgtgcgtgcgcacctatgtgcacacttatgtatacatgtatgtgcacgtgcataaatgaattaagaaagaaacaattcacccaaacaaggaggaaaagatgaacatctcaagtacctatgagcatttttacatgcagaccccttactgacattggccaagacagatgacaagagatcatcaaggagagagttcattagaaaaagatactgctaacattagagaaacatagcatcaatcacccatagcatggatgctgttgagcttccacctgaaaaacaaacaacaacaacaacaaacctggcgggtagaaataggaacaggtttagcattacatccctccctccttttcctgggacctgcattgggccccataagcttggcatgaacctaagtgaataagacaccaaaggactgaagtttaccactaccttcagaattaggactcagagccaggaatttctttagactacataaccagtctatgcatatgtgaggatttggactgtagttcacactggctgcgcttccttatggaaacagtgactacaagatggaggatattaatgaaagatagcacacatctatactaaatgtcataacagcaaaaaccataagatagttactgacaatgagtcatgcaattccgagggaaaaactagtatgctacattcctccatgctacattctttcaaataagaatgaaagaatcaagaatgggccttgaagaatgaagatgaggagaaataatgggtgtgtggaccacgcaatggagtgggaattcctagataaggaaaggtatatggtctgtttaattaagggactctaaaatacttgttaaaaaaaacaaaaaaaacagcaagtagtgctttccagtaacaaagtctactgcaaatttctttctgtacatgggaaataaggactgtgggattctttgggtggatcccagcacctagagttggatctgatcaaaaagaagtgctcagtaaacatttacctactgctttggttgccttccccctgtggagtgctggcctccaggattgagcttgcatcataggtgttcagtaggaacttgcttagtggatttacaggttgaggttagaacccatcaggattcttttcctggaaagaacaggcatgtgttcttcccttccctctaagttttcacatagacactgggtgaggaaagagccctaaattgcttgaaaaattgattgctctttgagcaaagcaagaaaccctcctgtggaagggcatcatttgggcatatatcggggtctcagtacgaagatgagtgctcaagacgtcaagatgcttaagcagagaatctgaccagaatgttcgtggtacagagaaacagttttgttgggagaaggatgacaattgaggctttcgaatataagctaaataagcttcaaagggtatacaaaaaagaatcaggtacaaatcctttactacattcttttgtacaaatcaatttttgtctagaaaatcataccttactatgcatccctattgtgttcctccaccatctattttgtttttttaagcgttatttcattttcatgttcacagaagcttgttgctacaactacatgagcaaaacagccagtagcaacagaaatgcattaatatctctcctcagacctttaaagcattttccttaaaggtgaacaatattccgcatacaaggactttttcaggactatgtgccagaaattatactgaatgtttcttaattttcacgtaaatcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacatttatgtagtagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctgggggcatatagagccactcagagccttagaggtaccctcagcgaaatggaaccaatcaccatatagtgtagcctattgttcatctgaccaaaatgcactatgttgcgatagcatggattctacagacccgtgaagcccatttggaccacaagacactctttccatcatgcctgcacacatatccctcactcttcattgattcatgcagacttttaaaagtatttagcaataagcatcctacccccaagaagcttatgatctcatggagaagatggccaagcaacagacaatcccgacatggtgaatgccgctaaaacaaatgcttacctggatctccgtgagtgctaggaggaaagcaacccaaactcagaaaagtaggagaggtgtcagggaagacattttccagaagatggtttcgtgtctaacaaagccgtgagacgagcaaaggggaggtgaaaggctcagcgttctatgggacatttccttaattccagtatctctcgagttgagtgtgggaagctaaaagggaggaaatagaaatgaaaaatgggagttcttgagaggctttacttaccctgcacaagccaaggacaggtctgcgggaagtaagcagatgcagttaggaaagcccatatcaggagttagtcacgacagagaaagatttgtacactttggaaatcataaaaggatgaaaagcccaggtccttatttccgtgttttcgcctgtttttcacgttcctcccggatttcaatttctttctggaatctcacctctcctcatcatctgctcttgcaggaacactaaactggaaacgcaaccctacgattcagcgaactatgtcccatcaagattactgggtacaaatacatttactttcgtgttctcttgtgactgtctgtatcactgcacacgtttgttactgtgaaacaagcattaaaagtctgtgtagattactgagtacatatgcatttctttttttttcttttttttttattatactttaagttttagggtacatgtgcacattgtgcaggttggttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtaattctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatggtatctcatagtggttttgatttccatttctctgatggccagtgatgatgagcattttttcatgtgttttttggctgcataaatgtcttcttttgagaagtgtctgttcatgtccttcgcccactttttgatggggttgtttgtttttttattgtaaatttgtttgagttcattgtagattctggatattagccctttgtcagatgagtaggttgcgaaaattttctcccattttgtaggttgcctgttcactgtgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggttttcatggttttaggtctaacgtttaaatctttaatccatcttgaattgatttttgtataaggtgtaaggaagggatccagtttcagctttctccatatggctagccagttttcccagcaccatttattaaatttcttttcttgttctcccgtgacttttgatatcactgcacacaactgttactgtaagatgaacattaaaaagtcacgtctggccagtacggggatcgaacccgcgaccttagcgttattagcaccacgctctaaccaactgagctaaccggccccgcttactaaaaccccccctaaacctcttgagaagtttaaaggcgaacgttatttcaatcaccaaagaaacttttctgaacttctcggaactggaaagaacctgcgatctttgctaacttgtttatgatcctcggcaaatttctccgaaccctgacatttcaattaaaatacaattctgaggaaggaaagttcaaatgtcacctgcttcactgtttcatgacaaggggtttcagtgaccacccttttaaacgcaacgccatcaccttccgccggtactttggcctgcccttctcactcctttctactttgcttccgtagcttctgagcaacccgtgaagaaattgacggaaaacggaaggaattaccgccagtttctttccacgggccgtcaaggccaatataagtccccacccaggctcctctgctcgtaacttccagcacgattcccactgtattagcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacgtttcgaataattaaataaaagaagtctcaaccaacccccttgctgtattacagatggtccagctctctgcctagactattgtgctaatgtcctgttccttctcccggcttttgaactagattctcacctctctccaatccatctttcgcagggctggcctgtctttccgcctcacttctgaaattctatccattgccgcctctgtgcaaaccgactctggttaatacttcagtcggtatggctcccctcttccgcactttgcactgcgagaaatgcccttctttgaggcagctggaggcctcctcctcctgagagcttaattgtggacacagccttgagtagaggcgaaaaggaaagaaggctgggagacaatcggggaaaaacacacacctttggtctggtttgaaagctggcgcccgaaaaggaacaagaaaaaaaacacgcttcggaagtgtctgagattgctgcggccataaagcagagcactaaccctggtactgatacgggaggggagcaagactccacccccgggcctgtgcccatgaacctaggtgaggaggggcacttcttcctccgcgcccaaatgttgcatttcccaagaccaccctggcccgccacgcccccatcctgtgcctataaaaacccccgagaccctagcgggcacagacacaagcggttggacatgaagaggaacacaccggcgggagaacacagaacacccaccctctctttagtcaccctggaggcctcggagaaggcggtttcagtgatccgtgaagagaccctgagtcttttacatcccggagaatgacaagagagtacctgggcgacgtaactttctgggttttccggagatgcggttttctacacgccaggggccaagcctgagaaataggtggacggcaaggacaggagctctctccgcgccacaaacgcccctgctcacacctgggttccttgattttcctgcctatataaccgagccacccatggccgggctccgagctctcattctgcggactgggacaaaggggttaactgtgatgtgctttgtataaccccaggattctgcacttgcccaagggcgaggtgcaaatccaaaatcacgcacgactgaacgccgagatcagctgagtcctgagtgcctcacgacacaaaatccgtatgatttttaaaagcgctgtatttgtgctgacaatgcatgtcagatcccatctgtctttagctcaatgtgtgacgttagacacgtcgttttgctcctcaactttcttatttggaaaaaaaaaaacgagtgttctagatttgcagagggccttttcagagctaagttccagtagctatactgtaagttgaactcgggcagtcctgttggtgaggaaaaaggacaaattgagaaatgaacaaacacagaagttgcaaaagccctgtgacttacagcacaggacaagtctacaaaccctgccatgccacactaagctcaagttgttttaacatcagtttactcagacccgatgatccaaggtaagaccaaagccaaacggatccagcaactgggcagatcttcatgttccagcagctaagttccacggaataaacctatgattcgcctagtttagaaattgtctagtccctcctcagaaggaccttactaactttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcgtttttgtcatatgacattacttgtattttacaggattcacttggtctccatctgacctcctcagagtagactgctctttcccaatcactcctgcaattaccctaggagatatgtgatcctaaagtaacggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaacataaaggcaagtatctttttcactcagttcaccttggttctaagagtgggtctatataaagaaatggaacatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaagtaatcatgttataaacaatatgaacataaaagcaaaaattacatggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctagtgtatccacaaaaataagcattataagtaaatgcagctatgtcacagattacagtatacaaaaattaattgtatttctatgtactagcatcaaaaaaatggaaaattaaattaccactttcaataggtttaaaacaaatgaaatatttagagataaacttgtcagtgtgcacaggacttgtacctaggaatctacaaaagatggctgagaaaaactcaggaaagcttgactaattggtgttgtttgacatatttacagattgaaaaaggtaatattattaagatatcatttttttccctctgagttgatctatagatttactacaatcccaacaaatatcccagcaggagatttttgttttgtttgttttgttttcttttctttttgtttgtttgtttttacagaaattgacaagcttattctgtaggacctagagtaacctaaataattaggaaaagaaaaacaaagttagaggacttacaccaggtgatgtcaagacttattataaagctaaggtaatcaaaataatgtggtattgtctcaaggatacttacccagattgacggaatagaacagatagtccagaaacagaccaacgtatgtggtcaactgatttatgacagaggtaaaatgtttttttaaacaaatggtcccaggcaactgagtatggaaaaaatgattccctacccttacctcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaatataagatgcttatatggccaataggcacactaaaagatgttcaacaacattaatcagtacaaaaatgcaaattaaatctatcaaggattaataggtaacaacagatctcaactcccctgaatggagaaacaattagtaacacagatattagataaagataagttacttgaaggatcaatcagtgaaaagatacttgggcttatttccaggtttgtgttcttaaaaagtgatgcattcaacagagcatttgaggtaactgctaattagggacggtacttccttctctttcatgtaatgggagagtgaaatcagattagaactagtgctttcctaatgagatcttttctctctttctcaggatcaggactcagattgaaaaagcagaggatggtcactgccttccaggtctgaggctgtctcccagaagcttcactcctggcttcgccttggtagggaagtttccggaggtgttcgaaaacctggaaacttaagtgggacataagacgatatttgtgtcccggttataaaaattggcagaaaagacaagtgtagtgtgggggattagctcaagcggtagggtgcctgcttagcatgcaagaggtagcaggatcgacgcctgcattctccagcttcttttaatccctaggctaccaatggtatctggcctagatgacagttgcacagtactcgttattgttgtggcagtatctatgaggattattggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggctatgccgtgaagctctggggctgggagaagctgccccaccacttccgggcggcggtggcggcaaggagcaggtgacgatcacaactctagagcgtgctggaatagctgtgcccccaagccaggcagttccgggtggtgcttctccatccagaatgtgctctctgattccgagagatgaagaaggcgaaattgggaagtgaggagagaggtctccctcatgaccttctttggaaatccctattcttcgcactggcaggctcatagaactttgctgaaggcagtatctgagaagctcggccctcaatctggtcctgccaggggtttggcgacacaaagcaccggcatgctcctaataaccaggaaaatgggtggggtgaaaagtttctcctctggggaattagctcaggcggtggagcgctcgcttagctatgcgagaggtagcgagatcgacgcccgcattctccagtttcttgtctggtttatgtctcttagtttgtattccccgttgtttctcctgttgatgacatcggtgcctcttacctgggagaagatcagaggaaactgccgcctccctagagcccgtgttttattgatccccgtgtaagagtcttgttgcccctgcttccatccttccttcttttccactcctgccacaggtttggcacttctaggtactcaggtgtcagtgcaaatttcccgtctttagacaagtacagctaaaagtgatgcccacacgatctctcagttcctattacatcttcacaaatatcgtctcctccggaaagtatgtctttgaattattggtttgtttttctctcccctagaatgggagcttcctgagtaccgaaacactgtctatgtagactgtgtttaactcacttcatcaccatgtgtagagttaaggttctataaaatacggttactgccttgaacagatgaggtgagtagtataaggaaacggagatca

SEQ ID NO: 177 - DNA, 52525 bp, Homo sapiens
ggttcttttaaaattcctttgatttttttttttttttttggcctgtttttcaagtgtccaatttttgtcacccttctcccatcaggtcagagagatagccaatggtcagaagcaatcttccagcaactgccatagcgctttctcctgcctgcagatgcctctttttagtcagcctttatgggaagtagcagcaccatccgttcccagagagcaagctctggagtagctgagctaaccccagttgctaatctgagctaatcccagttaccccagtggatttacagattgagggtagaacccagcagggttctcttcttggaaagaataggcttccctctaaggtttcacatagatactgggtgaggaaacagccctaaatggcttcagaaattgaatgttctttgggcaaagcaggaagccctgctgtggaagagcatcatttgagcataaatcaggttatcaggacaaacagagtgttcaggaggtctagatggttaagcagagagcctcatcagaatatccgtggtgaagagaaacaatcttgctgggagaaggataaccgtaactggggacttagaataaaggctaaaaatgattcaaagagaatgcaaaaagaatcaggcacaaatctttactatattctgttgtgcaaatctcaccttactatgtgtttatattctattcctccacaatctttattttatttttatgttcacagagacttgctggttccaactaaatgagcacaacagccagtgacaacagaactgcacttaaatagtccctcatcagctcttgagagcagattccttaaaggtgaacaatattccacatacaaggacttttcagcagtatgcattagaaatggaactgaatgtttattattctttatataagttggttgatacgacttttcagcttccctcagtaacattatctaaattttgtagatgacagtaaagctcagaggagttaaaccattttcctcaaatcacgtagctttaaacaggaaaaccagatatgaaaagcagatttctttctaaattaaaaaacaaaaacaaaaaaacttgagctcttgctttaccctagcacatagtctcgccatctgttttctccacaccaggtcattcatgtaacattcattcacataacaaatacaaataaatgagcggattcattcatcagatattaattcagaatctcttttgtgtctaccacactaggctcaagacgtcccagtgtctttgtctcctctccctcaaatctctccacccaatatcttgacaaataaagtagatccttcctgtacaacgtctccagaatcttttcttccttttctttcacctctgtcatcattcatgctacagtgtttacggaggatgtgttctgcagcatgaagtgtcgtgggcactagctctgcagaaagacttctgctgtccacctcaggtgctgacatgataaatgtgggtaaacctcaatcctttaatatctttatgacttctttccctttctccccagttcctgttttctcatgttcaagctctgacattcaaaactaaacacctttctctaacatgttgctttaattatttaagcattctgcctgggatattttcagttagtcatgggatttttcataaaactctcccaatatatctccaagtggccaggcttttcaatcactgcttccctccatgtgtatttcacacacacacacacacacacacacacacactctccacttaaattgaacaggtttatttctttacacaagaattcttacaaacagcccggttttctccaccatatgtccactccttctctgcatagctcaattttgattcttacactatattttacatattcttacactctgatacgatcttgtctcttattctttatggctctgctctgtaattttgttgttgttgttctgaaatatagttggacatgtaacttgtacatgacacaccttagcaaggaggcaactcatatctcagatgtaagtgaaagaagcactctccaggggtttcctatgggagtggtcagcacgctggcctcattggtggaatggcctagttacgaaaacagcaggagctttttgccttccagaaatctggaccatctcacaacccccagacagtctcagctacaaggaaaagtgataattccatcccacttttataaacacacacaaacacacacacacacacacacacacacacacacacacaatcatttaatcatttttaatcatttaatcatttttttaaaatctctgacactttagctgggcaggtctagacatgtcctcctttgctgggatgtgcctttttctgtcccggaataccctaaacttgacattttggcagcacgagttttccctttgtgactttctccttgttccctttctcctccttctttgcagagaatgagtagccactgcgccttgccctgggccatcagtgagaagacctgctcttagtagagccctgctttcccgctgaaggccttgaaatcccctgtgttccaggacacccactaaagatcaagaaagctcccctgacgtggggaattagctcaagcggtagagcgcttgcttagcatgcaagaggtagtgggatcgatgcccacattctccaagctttattatttggaccttgggtctccaaacactcaagtatccaaacccaagttagtgtctgagagcaggatgctgctttggttcaagacataggagcagcaacaatacaggcctggtgatggctccctcctggcattcagtatagtgtagatctactgtgtaattcatttgctgtttcctcaaggagctgtgaaaccaagggacatatacaactgctcttttctccctgtttctgcctgcagcttggtcctaaacctcagacaatcgtgaaatgtgcagggcagagccacctgggtaaacacagcctcggctttctgctcaggggactgaaaccaggatgtgtcaagtaactagaatgtgcctggacagatactgtagaaagcaaacccataaagttgttcatgagcttgtggacacacctgccagctgtgaataagtggctctaatcccaaacaacttacctacaaagagcctgagagctgaactgcgcaatggcccactttccagtcctcactgaagttgcacacactccggaaatctctgaacagtggcgtaaaggctttgcaaatagagttatctttgaaacaacaacacgtggaaggctggttggtacttggaacttgaatacaaggcaattttgtgcctgcaaaaacaaaaatagcaatattattcttaagatttcaacaaaacacagtgtctcatcacataatccaaagaagtccaggttacaagccccaaaatcttcggcattatgaaaaaaacagggagatcttcattcacatggcaaagagactcctcgaataacaatactgagaggacacagatgtcaaaatcatctgacgcatacagtggagcagttatgataacaatgctcctagaattaggggataacattcgtgaagtgaatggaaagttggaaagtctcagcaaatatctggaatatataaacaccaattttaagcttaagaatttaaaaaaatgtattaaccaaaactcttaggggaaataaaaagcttaactggatgatctcgataacagaatgcagatgactaagaaaaagtcaacgaacttgaaaacagaacaagaatacctacataatctgagctatagagagaaaggagtatttctgtaaatgaacagaggctcagggacaaattaaaaaatagcaaatctaacattcacattattgtaatctgaaaagaagaggacaaagaggtctttgtgggataaaactttgaagaattaatggctgaaaatgtatcaaatttgtcaaaagatataaaccaggtttttaaagttcagcaaaggtcaagcaggataaacccaaagaaacccaacccatttcaagacgtatcataatcaaactgctgaaaacgaggaaagtacaaaacaatcttgaaagcagtcaaaggaaaatgaaaaagaaactaccatatgaatgagtgtagatttctcatcaggaaccatagcggccagaaaaaaatgtcataatgttcagtaagtaacaaaagaaaaagacctatcaacccagaatgctatgtggagcaaaagtatctttcagacataaaggcaaataaatgcattctcattggaaggtaagtcaatacattctcattcttagcaagaatgctggaaaagaattagcaaagatttgagataagaaaagtgataccagaaggaaacttagaacatcgtcaatgaaggaacgaaagcagaaatagaaaatgtctgggtagacataacagactgttcttcttctcctgagttccttaaggtatgtttgatgattgaaagccaaaattgtaactttatcagaagcagttgtcattgtatcgagatgtactacatagataagataaaagggtaagtgtaatgggcctaactcttgatgaagtttctatattcaacttgaatggtaaaatattgattctaagtatactgtgaaaagttatatacgtatatggtaatccctagaccacttactaaccagattgaaataaaccaaaacaagatagacagaggaacatagaagaattaaaacaaagggaacaaaggttaatacattattaaatagatctatctaaaaacttatctatattaacattacacgtaaatgatctaaatccttaattaaaaactagagatcatcagaatgtattaaaagtaaatatgctgactgtaagaaagccacctgcaatacacttatatatcagaataaaagttatatagcagattgaaggaaaagagtgggaaagatacctcatgcaagcattaatcaaagacagctgtggtgtatacattaaaatcagacaaagtagatttgaaagcagagaaacttttcaggaataatgaaggctgctagataattacgaatgtccattctccagggaatactgttccaaatgtatatgaggacacagattttcaaaactcataaacaaaattagataagccaggtaaaaatagaaatatccaattttagttgaagacactaaaactcctctctcagtcattggtagacttagtagacaacaaatcagccaacatattggagaactgaaccacaccatccaccaatggatctgatcaacttcataacgcaaaataaaaatttagccagaaagcaaagacaaaaattaaaagaaaagtaagatcatgttataaccaggaaattaagagtggtccatcatatagaagggtgctattattgaaagagtttgaaatagtgacttagttattttgaaagagttttgaaggcattatttagctggaaatgacagaaagactgaaaatggtgaatctggaggtggatcttccctcatctatatttatcttgttttcttttgaggtctagggtgtctatacttcctctgaattacctgatcctactacagtgtctggcacagagcatctccccagtgaatatgtactaaatgagtggaaagtaattgatagattcaaaagagttgtgcaagaataatgttcattatttggcaaatcattgaatgtggtgtttgatggaagacaatgaatcaaagttgacttgaaaggtaagcccaaggccagacgtggtggctcatttctgtaatcccagcactttgggaggccgaggtgggcagatcccttgacgccaggagtttgagaccagcctgggcaacccagtgaaatcctgtctctacaaaaaaaaacaaaaattagccgggtgtggtggtatgcatctgtagttccagctactcaggaggctgaggtgggagcatcactggaacccgggaggcggaggttgcagtgaacagagatcacaccagtgccctggcagtaaagtgacaccttgtcttaaaatgaaatgaaatgaaatgaaataaaataaaataaaataaataaaataaaataaaataaaataaaataaaatataaaagttaagcccaggccgggcgcagtggctcgcacctgtaatcccagcactttgggagaccaaggcaggcagatcacctgaggtcaggagtttgagaccagcctggccaacatggtggaaccccgtctctactaaaaattcaaaaactagcggggcacctgtagtcctagctactcgggaggctgaggcagaagaatcacttgaacccaggaggcagaggttgcagtgagccaagattgtgccactacactgcagcctgggcaacagagtgagactccaactcaaaaaaatttttaaaaaaaatttttaaaaagttaagcccaaaaggtaagtaaagaggaggtctggaattagatatttggtgtatgagtgaatgagctaaagtgcaaaagaatgggcagaataaccgtgagctggagcagagggaaaaaaatcacatgcaaaatctaaaaatatctgcttctcaattcgggctttcccacttagcagctttggcatttaaaaaaaaaaaaaaaaaaaaaaaaacacttgaccgggcacggtggctcacgcctgtaatcccagcactttgggaggccgaggcgggcggatcaggaggtcaagagatagagaccattctggctaacacggtgaaaccctgtctctactgaaaaaatacaaaaaaattagccgggcatggtggcgggtgcctgtagtcccagctactcgggaggctgaggcaggagaatggcctgaacctgggaggcggagcttgcagtgagcccagatcgggccactgcactccagcctgggagacagagcgagactccgtctcacagaacaaacaaacaacaaacaacaacaacaaaaacgcacttagcctatctgattctctattacttctaaaaagtgcatactaaggcataattttgttggcaaaagtcaatcagactacatcaagtaaactccctaagtctcctagtataattcacggcacaaaaatatgaggaaaaacagggaggatatgattaaaagtttagtttgtattttttgttgagtgaatgtctccagtcatagagatgcaagtgtagatacacagtaagagtagtatgaatggcagacaccttggaaggctatttcttccttcattcattcagttggtcactcaatgaactatcatgaattgagcactacctctgtttcttatcaacaaaggagactacggaaaggaagaatgactaagatctctgaagaagggaaaagctagatgactgggccacaagaggaaaaaaagcagcaagacaggtacaattgtgtctagtccctcaagccagaaggtcctatcattatgtgaatactggaaacgggtggactccacctgtcctgagtggggaattcttccagtgcagcattgactgataaggagtgatttccaagtagcattgattgtgttctttaaaagctaggaattgataaagcagcagtgcgtgggaaatgagatttaataatctggatgtcacctcttaggaacagttgctctcttagagcagcaggccacctgtcaatctcgtattctgaaggtcctgagtttgaacatgagacaaggcacagcttatgccgctatttccattaagagaaatgaaataggtgtgataaataatggaacacaaatgctatgagataatgatttcaagacagaccaaatattagcttaaaatttaaaagtgagttttcttttcttttctttctttctttttctctttctttctttctttctttctttctttctttctttctttctttctttctttcttccttgcttccttccttccttctttccttccttccttccttccttctttcctttcctttctctgtctgtctttatttattttttccttcttttggcttctcagtcgcttgagtacaaggcgtggtgaaggcatataaattacaccagaaactgcaagctatgtcttatgtctacctctctagctgacaggggaggcaggggaaatttctcttccaattgcctgctctgaaggtcatccaaacataattatggggtggggtgggtaaagtcttttattcttttaatcgtccaaccgatagttctcaacacatatcttgttaagagactgttttgggtatagcaattcgcagtgaataaaatacagatattctcacctttgtgatactacgtcaatgttggggggagtggggagaaagagacagaagcaaaaaagaaaaataaacaagaagtcatgtgatattatctactgggagggagtcattaggcagtaaaggactcggcagtgtggaggtgacacattcacttttcaggagaagaatcagggaagttgtcaccttgaagatatcatttagcttccctttcttccaatagtctttctttacatgggaaatgaggactctaggattctccggctggatctcagcacctagagatggatctgggcaataggaactgctcagtaagcattacctactgctttggttgccttctccctggcctcttggattgagcttgcatcatacgtgttcagtaggaacttgcttagtggatttacaggttgaggttagaactcaccgggattctcttcctggagagaacaggcttccctctaaggtttcatatagaccccgggtgaggaaagagccctaaatggcttgaaaaattgaatgctctttgggcaaagcaagaagcgccactatggaagggcatcatttgggcctatatcagggtctcagtacaaagatgagtgctcacgtggtcaagatggttaagcagagaatctgaccagaatgttcacggtgcaaagaaataatcttgttgggagaaggatcacaacaattggggaattagaatacaggctaaatgagactcaaaaataatacaacaagaatcaggcacaaatcctttactactacattcttttgtacaaatccattttgcctagaaaatcataccttactatgcatccctattgtgtttctccaccatctattttactttttaaactttatttcatttttatcatcacagaagcttattgctacaaaacaaatgagcaaatcagccaatggcaacaaaactgcactgatctctctccttagaccttcagaacattttccttaaaggtgaacaatactccacgttcaagaatttttcagctctatgtgctagaaactatactgactgtttattaatttttatgtaagttggtcgatatagtttttcagcttccccaagtattattaccctagtgttacagatgacactgaagctcagagcagttaaaccattttccttagatcacataactttaaagagggaaaccagatatgagaagcagatttctttctcaatgaaaaaaatcacaagctcttcttgctttagtctagcacatagtcttatcatctattttcttcacaccagctcactcatgtaacattcattcatttaccaaatacagataaatgagtggatttattcttgcatcgatcagatatgaattcaaaatctcttctgtgtctgccacaccgggctcaagacttgccagtgcctttgtctcctctccctcaaatctctccacccaatgtcttgacaaatactgtagatccttcctgcataaactctgcagaatctttttcttctgttttactcacctccttctttatccatgctatgatgttcatggaggatgttttcttcaccatgaagtgtgaaggggattgaagctgcagaaagactcatgctgttcacctcaggaactgacacagtcaatgtggataaatctcaatcctttaatatctttatgacttctttctctttctccccagatccagtttttccattttcaagttctttgacatttaaaactaaaaacctttccctaaaatgctgcttttctacctggaattttttcaatgagtctttagcttttataatattctcccaacatatctccaagcatccaggcttttcaatcactacttccctccgtgtatattttacacacacacacacacacacacacacacacacactccacttaaattgaacaggcatatttctttacacaggaattcctacaaacattccaccctatacctaccctaggttttctccaccctatgtccactctttctctgcattgctgaatgtgttttctttattctttcactctgatatgatctttgtctcttattctttatgcctcttatctgcatttttttgttattattgttctgccatgcagttggatatgtaacttttacatgacacaccttagcaagaagacaacacatgtctcagatgtaagtaagaaaaacactctccagggatttcctggtgtagtgctcagcaccctggcctcattcctgaaagtccctcggtgtggaaaaagcaggagctctttgccttccagaaatctgcatcatcccacagcctcagctacaagaaacaagtgacaatgccatctcttttcttttaaaaaaatcatttaagcttcctgagatatctgtgacacattagctgggcagggtccttctgtgggacatgtcattttccgtctcggaatatgtgaaacttgacattttggcaacaccagagttttccctttgtgactttctccttgttcccttttctcctccctcctcacagagaataagtacccactgcactcttgccctgggccatcaatgagaagatctgctcttagtggagccctgctttcgcggtgaaggccttgaagtcgcgtgtgttctagactgcccactaaggatgaaaaaagatgctgtgagatgaagaagtagctcaagtggtggagtgctcgcttagcatgtgagaggtagtgggattgatgcccacattctccaggtttcactagtcggacctcaggtctccaggttacagtggaaaaaaatatgtgttagacactgatctcagaaaacagtaagttagacactcatctcagtagcagcctggacacttctttggctcattatgtaagggcagcaacaatacgggcttgactaagattctactggtatgtggtatagtatagatctatcgatgtgtaattagttttctgtttctttgaggagctgtgatacaaagggacatatccagttgcacttattctccctgtttcctcctgcagcttggtcctaaatgcagcataattatggaaagcgcagggcagagccactcaggtaaatacagccccagctttctgatcgggagaccgaaactaggagttgccaagtaaccaggaaagacactgtggagagcaaacctgtcaagttgtatgtgaactcctggatgcgcctgtgagctgtgaataagtggctctgatcaaagacaacttatctaaaaagagcctgagaatcgaactaagtgatagcctactttccagtcctcactggccactgggttgcacatactccagagtctctgaatagcagtgttaaggctttgaaaatagaatcgactttgaaactacaacacacaaggctggctggttattggaacttgaacacaaggcaatcacatgcctgcaaaaacaaaaatagcaatattatccttaagatttcaacaagacacagtgtctcatcacataatgcaaagtacaaccccaaaatattcagcatatgaagaaccagggcaatcttaattcacttggcaaagagaatcctcgaataacaatactgagaagacacagatgttacaatcatctgacacatacttttaagcagttattacaacaatgctccatgaatgaaaggataacactcttgaagtgaatggaaagttgggaagtcttagcaagtatctggaagctctaaacactgattttaaacttaaaaattaaaaaatgtattcatcaaaactattaggagaaaaaaaacttcaatgggttatttcaataacaaaattgagacactcagaataaagtcaatgaacttgaaaacagaacaaaaataccaacctaacctgaacaatagagaaaaaggagtgcttttgcaaatgaacagagcctcccggacaaacagaaaaataagaaaaatctaacacatcattgtaatcctgcaggaagaagagaaagaggtcctccagaaagaaaactccgaagaattaatggctgaaaacatatcaaatttatcaaaacactttagaagttcaataaatgtcaagtaggttaaacccaaagaaatccatacccagacacatcataatcaaactgctgaaaactaaggaaaaccataaaaatcttgaaggcagccaaatgaaaataaaagggaaactgccacttgaatgactgtggacttctcatcagaaaccataggggcccaaggaaacatttactaaataccaaaagaaaagacctgtcaacccagaatgctatgtagagcaaaaatatctttcagactaaaggtaaataaatacattctcacaggaaggtaaactgagagaattcattgctggtagaactgctggacaagaattagcaacgatttaagatgagaaaaatgataccagaaagagacaggacaccatcagtgaaggaacgaaagccgaaatagaaaatgtctgggtagacattacagactattattcttctcttgagttccttaaggtatgtttcatgattgaaagcaaaaattgtaactttatctgatgcagttgccattgtatctagatgtgctacatacataacataaaagggtaaaggtaaagggcctaactgctgatgaagtttctatattcaacttgaatggtaaaatattgattctacgtatactgtgaaaggttatatatgtatatggtgatccctagaccacttaggaaccagatttaaataaaccaaaataaactaggaagaagaacatagaagaattaagacaaggggaacaaatgattaataaattattaaaaagtagatctatcggctgggcacggcgtctcacgcctgtaatcccagcactttgggaggccgaggtggctggatcacctgatgtcaggagtttgagaccagcctggccagcatggtgaaaccctgtctctactaaaaatacaaaaaattagccaggcatgaagccgggtgcctgtaatcccagctacttgggaggctgagacaggagaatcacttgaacctgggaggcagaggttgcagtgaggggagattgcaccatggcactccagcctgggtggcaagagcaagactccatctcagaaagaaaaacaatagatctacctaaaaacttatctataaaaacattaaatgtaaatgatctaaaacaatgaattgaaaaccagaaattgtcagaatgtattataaatgaatatgctgactacaggaaagtcactagtaatatacttatatgtgagattaaaagttatatagcatattgaaagtaaagaatgggaaaagatatgtcatttaggcattactcaaagaaagctgtggtggatatattcaaatcagacaaaccagattttaaattgtagaaaacttccagggataaagggggctgttacataattagaggtgccaacacaccagagaaataatgtcccaaatgcatataaggacacagggcttcaaaactcgtaagcaaaattggataatccagataaaaatagaaaaatccaattacatttgcagacgttaacagtcccctctcagtaactgatagatccagtagacaataaatcagtaaacacatttgagacccgaacaacatccatacagcaatggatctaatcaatcaactttctacagcaaaatcacaatttgggtagaaagaagagaaaaaaaataaaagaaaaacaagatcatgctataactaggaaatcaggaatgttcagggtgcaaaagagtgatatattgaaactgacatttttgaaagggttatttagctgtaaatgacatgacacggagactgaaatcgtaaaactggacgtggatcttcccttctccatatttgtcctgccttctcttgaggtctgggctgcttgaatctttagaatctcctgaacttaccacagtgtctggcacagagcatcttccctgtgaatgtgtactgaatcaatggaaaggaattgacaggttcaaaaatgttgtgcaggaataatgtttactatttcacaaatcactggatgtggtgtttgaaggagaaaaatgtgtcaaaagttgacttggaaacaaagcccaaaaggtaagtgaaggggatttggggaatgagatatttggtgtgtgaatgaatggggtgctgtggagaggagtagggagtaagattgtgaactggagcagagaaagaatcacgttttaaaatctaaaacatcttctcctcagttcaagctttgacacttagcagctctggcaccttggaaacaaaacttatctgaggttccattacttctagaaagtccagattaggacacatagttttgttggtgaaactctgttggactacatgaagtaaattcaataaatctcttagtataattaatggcatacaagatttgctttacactttttgtagcaggattgtctccagtcgtgtagatgcaagaggagatagagagtaagacacagtagtatggacaggagacacctttaaagactattttttcattccttcattcgttcagttggtcagtcagtgaactattatggactgaacatgtcctgtgtgtcttttcaaaaaaggacaccataggaggtgtaagagtgattaagatctctgaaggagggagaagtcagatcactgggccacaagagggaaaaagtcagcaaaacaggtacaattgttcttggcctcttgcctcaagatggtcgtcttgttagatgaatactagaaatgggtagattccacctgtcctgaggataaaattctttgggtgcaggattggctgataaagagtgatttccaagcaccattgattgtgttctttgaaagttaggaactgataaagcagcagtgcttgggaaaatagcacgtgggatgtcaattcttgggtgagaaccgccctctttctgcagcaggccacacatcaatctcataatctaaaggttttgagtttgaacatcagagaggatacagtttttgctgctatttcagttgagggaaacaaaatgggtgcactaaataatgaaatgcaaatgctatgagataacagtttgaagactgactcaacattagcttagaatggaaaagtgatttcggttttttggagtttttttgttgttgtttgtttgttttttggcttgtcagtggtttgagtaaaatgagtggtaaagggatatagattacagaagaaactgcaagctatatcatataattggtctttctcactagctgatggaagaaacaggaaattttttgtcgagctttctgctctcaaggttacccaattgtaattatgaggtgagtgggtgaagtcatttattcttttatcctacatgtatttctcgagcacgtatcttgttaagagactgttcggggtacagccattcaacagtgaaaaaacgcatatattcttcacctttgcgaagctagtttctagttgataggggtgaagagaaacagatcagaagcaaacaagaaaaatacataagatgttatgtgacaacgtctactgggaaggaacccacaggcagtaagggacttgggagtgtggagatggcccattcagaagcttttaggagcggaatctgagaagttgtcaccttgaagacatcctttacccaccctccaccccctccccactccccactcctgctccttccttcaatcatctttcttcacgtaggaaatgaggactgtgggattctctggctggatcccagcacctagagagggatctgatcaataagaactgctcagtaagcattacctattgctttggttgccttccccttgcagagtgctggcctcttggattgagcttgcatcataggtgttcagtaggagcttgcttagtggatttacaggttgaggttagaacccaccgggattctcttcctggaaagaacaggcttccctctaaggtttcacatagaccccgagtgaggaaagagccctaaattgcttgaaaaattgattgctctttgggcaaaacaagaaaccctcctatggaagggcatcatttgggcatatatcggggtctcagtacaaagatgagtgctcaagaggtcaagatgcttaagcagagaatttcaccagaatgttcgtggtacagagaaacagtcttgttgggagaaggatgacaattgaggccttggaatataagctaaataagcttcaaaggggatacaaaaaagaatcaggcacaaatcctttactacattattttgtacagctcaatttttgcctagaaaatcataccttactttgcatccctattgtgttcctccaccatctattttgtttttttaagcgttatttcatttttatgttcacagaagcttgttgctacaactaaatgagcaaaacagccagtagcaacagaaatgcgttactatctctcctcagaccttgaaagcattttccttaaaggtgaacaatattccacatacaaggaggttttcagcactatgtgctagaaattatactgaatgtttcttaatttttacgtaagtcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacattaatgtaatagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctggggggcatatagagccactcagagccttagaggtacgttcagtgaaatggagccaatcaccatatagtgtagcctattgttcgtctgaccaaaatgcactatgttgcgatagcatggattctacagacccgtgaagcccatttggaccacaagacactctttccatcatgcctgcacacctatccttcactcttcattggctcatgcagacttttgaaagtatttagcaataagcatcctacccccaagaagcttatggtctcatggagaagatggccaagcaacagacaatcccaacatggtgaatgccgctaaaacaaatgcgtacctggatctccgtgagtgctaggaggaaagcaacccaaactcagaaaagtaggagaggtgtcagggaagacattttccagaagatggtttcgtgtctaacaaagccgtgagacgagcaaagaggaggtgaaaggctcagcgttctatggggacatttccttaagtccagtatctctagagttgagtgagggaagctaaaagagaggaaatagaaatgaaaaatgggagttcttgagaggctttacttaccctgcacaagccaaggacaggtctgcgggaagtaagcagatgcacagttaggaaagcccatatcaggagttagtcacgacagagaaagatttgtacactttggaaatcgtaaaagaatgaaaagcccaggtccttatttccctgttttcgtctctgtttttcacgttcctcccggatttcaatttctttctggaatcttagctctcttcgtcatctgctcttgcaggaacactgaactgcaaacgcaaccctacgattcagcgaactacgtcctatcaaggttactgggtacaaatacatttactttcgtgagttctcttgtgactttctgtatcactgcccacagttgctactgtgagacaagcattagaagtctgtgtagattgctgggttcacacacatttacattctttttctcttgtgagctttgacgtggctacacataattgttactgtgaaataaacattagaaaagcctgtggcccgtgaaataaacattagaaaagcctgtggcccgtacggggatcgaacccgcgaccttggcgttattagcaccacgctctgaccaactgagctaaccggccccgccggcggaacggaccctacctctcttgagaagtttaaaggcgaacgttattccaatcaccaaagaaacttttctgaagttcttggagttggaaagaacctacgatctttgctaacttggttacgatcctcggcaaatttcttctaacctggaaatttcagttaaaatacaattctgcggaaggaaagttcaaatgtcacctgcttcagtgtttcacgacaaagggtttcagtgaccacccttttaaacgcaacgccatcaccgtccgccggtactgtggcctgtccctatcactcctttctactttgcttccgtagcttctgagcgacccgtgaagaaattgacggaaaacggaaggaattgccgccagttcctttccacgggccgtcaaggccagtataagtccccacccaggctcctctgctcgtaacttctagcacgattcccactgaattcgcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacatttcgaataactgaataaaggaaatctcaaccaacccccttgccgtattacaggtggtccagctctctgcctagactattgtgctaatgtcctgttccttctcccggcttttgaactagattctcacctctctccaatccatctttcgcagggctggcctgtctttccgcctcacttctgaaattctatccattgcagcctctatgcaaaccgactctggttaatacttcagtcggtatggctcccctcttccgcactttgcactgcgagaaatgcccttccttgaggcagctggaggcctcctcctcctgagagcttaattgtggacacagtcttgagtagaggcgaaaaggaaagaaggctgggagataatgggggaaaagcacacctttggtctggtttgaaagctggcgcccgaaaaggggagcgaaaggacaagaaaaaaaaacacgctccgaaagtgtctgagattgctgcggccataaagcagagcactaaccgcggtactgataagggaggggagcagggctccgccgccgggcctgtgcccatggatctaggtgaggacgggcactccttcctccgcggccaaatgttgcatttcccaagaccaccctggcccgccacgcccccatcctgtgcctataaaaactcccgagaccctagcgggcacggacacaagcggctggacgtgaagaggaacacaccggcgggagaacacagaacacccaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgagctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaaaaacaaaaaaaaacaagtgttctagatttgcagaggaccttttcggagctaagttccagtagctatactgtaagttgatttcttgggcagttctgttggtgaggaaagagggcaaattgagaaatgaacaaacacagaagttgcaaaagccctgtgacttacagcacaggacgagtctacaaaccctgccataccacactaagctcaaattgttttaacaccagcttactcagacccgatgatccaagataagaccaaagccaaacggatccagcaactctgcgcagatcttcatgttccagcagctaagttccactgaataaacctatgattcgcctagtttagaaattctggccgtgcgcggtggctcacgtctgtaatcccagcactttcggaggccgaggcgggcggatcacaaggtcaggagaccgagaccatcctggctaacacggtgaaactccgtctctactaaagatacaaaaaaaattagccgggcgtggtggcgggcgcctgtagtcccagctactcgggaggctgaggcaggagaatggcgtgaactcgggaggcggagcttgcagtgagccgagatcgcgccactgcactctagccgggacgacagagcaagactccgtctcaaaaaaaaaaaaaaaaaaaaaaaaagaaaagaaaagaaaagaaaagaaaaagaaaaagaaattctgtccagtccctcctgagaaggaccttactaaccttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcatttttgtcatatgacactacttgtattttacaggattcacttggtctccatctgacctcctcagagtagactgctctttcccaatcactcctgcaattaccctaggagatgtgtgatcctaaagtaagggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaatataaaggcaagtatctttttcactcagttcaccttggttctaagagtgggtctatataaagaaatggagcatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaattaatcatgttataaacaatatgaacataaaagcaaaaattgcaaggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctaatgcatctacaaaaataagcattataagtaaatgcagctatgtcacagattacaatatacaaaaattaattgtatttctatgtactagcatcaaaaaaatggaaaattaaattaccactttcaataggtttaaaacaaatgaaatatttagagataaacttgtcaatgtgcacaagacttgtacctagaaatctactaaagattgctgagaaaaactcaggaaaacctgaataattggtggtgtttgccatatttacagattgagaaatttaatattatttagataactttttttttctctgagttgatctatagatttagtacaatcccaacaaatatcccagcaggagtttttgttttgttttgtttgtttgtttttacagaaattgacaagcttattctgaaggacttagagtaacctaaataattaggaaaagaaaaacaaagttagaggacttacaccaagtaatttcaagacttactataaagctaaggtaatcaaaataatgtggtattgtctcaaggatacttacccagattgatggaatagaatagatagtccagaaatagaccaatgtatgtggtcaactgatttatgacagaggtaaaatgtttttttaaacaaatggtcccaggcaactgagtatggaaaaaatgattccctacccttaactcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaaaataagatgcttatatggccaataaggcacactaaaagatgttcaacaacattaatcagtacaaaaatgcaaattaaatctatcaaggattaataggtaacaacagatctcaactcccctgaatggagaaacaattagtaacacagatactagataagttacttgaaggatcaatcgataaaaagatacttgggcttatttccaggtttgtgttcttaaaaagtgatgcattcaacagagcatttgaggtaactgctaattagggacggtacttccttctctttcatctaatgggagagtgaaatcagattagaactagtgctttcctaatgagatcttttctctctttctcaggatcccgactcagattgaaaaagcagaggatggtcactgccttccaggtctgaggctgtctcccagaaacttcattcctcgcttcgccttggtagggaagttcccggaggtgtttgaaaagctggaaacttaagtgggacatggaacgatatttgtgtcccggttatcaaaacaggcagaaaagacaaatgcggtgtgggggaattggctcaagcggtagagcgcttgcttagcatgcaagaggtagcaggatcgacgcctgcactctccagcttcttttaatccctaggctaccaatggtatctggtaaatactttcagcggatttaccgctctttatttgactcagtttcatcttgttatgtacattttttttttaaggaaattatacatagcattccatgcaaaagcaaaaaaggaagcgattagtcacaagtgagttttgccaatacaggttttggggcttcagctcgaagttaatacaatgtatttttgtggggaaatcaaactttagccttttgggtacaaaatatgaggaacagcctggaaatagtgtcaggaggcaaaagcaggagacttgaatgtgccaaccttttgcttttattcacattgacaacacatggtcaggtagaggatgaaaacgtgtcttctaccagattatctgagagttggccaggctcccaccttcacttatactccttccttacctctctcctgtgtaggtaagagaggtaaggagagaggtaaggaaggagtataagtgaaggtgggagctagcatattaactctagtggtcggatacactctcactaagaaaagtgacatttattccttctattcatctctctgaaagctcgttctgacaaaaatgtgctcaaaataaatggggacctaggtcttcctctaatttccaagatgaaccaaaacgtaaaaaaatgtatttttgaaattgcaacactatcccctatttaaagaaactacatgaggcgctgtattaacaacacatatgttgactagctcaactggcccaagcagagctcagaatgctggagagagtggtctttggatagatgactccaggaagctcttgtaggtccctgggacgtgcccctctttccatccttctttctttcccatcactcaaatctctctctgacaccatttgacttctcagcattgccctttgttaatcgtaatagaaagacaatgttattgattacatgtttttctattttatcttcttattcataaatgatctcaaaaatgaatgtcataaataataaacatgttgttgaatttttgtcccataggagcagcctctttccttctcaggatgtgcactcctaataaactgggaccgtgaaggagggacctgaagctgccccaaaccacctgcagttccatgaaggccatgcctccacccactaatcactctgaaagtagtgcccctccactcttccccaaccacatttccttttcaggcaaaaacatttctatgggtttgttagaccctagcttctaatcctttcttcagtctttactgatctgaagccactctctcctttgaggcttctaaattatctgtatagcctttctccattcagcaaattttcatcaggcaaaaatcctacttgacgctagttatactcagagtaaaataactatgttcctgtcttaaatgagaattcttcacaggtggaaagcagatttggaatccactacaactccaaggcagtggagctaatgtagcctcccctgggctacaggggaagccttcttctgtgggcccgggaattgaagaactagacaggcataagaaggacaagtgtggtgcccaatggagcaagagaaggggggaggaaggtgacagggaagggaaatggcaggagaagcacctacacagcagacacggtatagcctgcatctgtttttccttttggctgagagatccctgagctctgtggtgacaattttccataatttttcatataaaaaatgaagattataaactatttctaggcattttacctgcattactattaatatgtgtacagcatctaaaatagggtctagacggcaattgcacagtactattacttgctattgttgtggcactttctatgtggatcactggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggcgcgtatggcgtgaagttctggggctgggagaagctgccccactacttccgggcggccttgcctgcagggagcaggtgaggatcacagctctagagcgggctgcaatagctgtgcccgcaagccaggcagttccgggtggtgcttctccaactggaacgtgctctctacttccgagagatgaagaaggcgaaattgagaagtgaggagagaggtctccctcatgacctattttggaaatccgtattcttcacactctcaggctcgtagaactttgcccaaggcagtatctgagaagctccgccctcaatcttgtcctgccagggatttggcggcccaaagtaccggcaggctcctgataaccaggaaaatgggtggggggtggtgtatcctcagtggggaattagctcaggcggtagagcgctcgcttagcatgcgagaggtagcgggatcgacgcccgcattctccagttccttgtccggtttatgtctcttggtttgtatacccgcttctttctcctgttgacaacggcggtgcttcttacctgggagaagatcagaggaacctgccccctcccccgatctcgtgttttactgctccccatgtaagagtcttgttgcccctgcttccatcctcccatgttttccactcctgccacaggtttggcacttctagctactcaggtctcaatgcaaatttcccgtctttagacaagtacagctaaaagtgatgcccacacgatctctcaattcctactacatcttcacaaatatcgtctcctccagaaagtatgtctttaagttactggtttgtttttctctcccctagagtgggagcttcctgagtaccgaaacgctgtctatgtacactgtgttcaactcgcttcatccccatgcgtagagttaaggttctgtaaaatacggttactgccttgaacagataaggaaacagggagatcaaagacagagcaatacttaaaaacattatcctgccacatttctcaaatcttaataatagcattcactaatgtttttggtttttctttgtgctttctccatatccccttattattattattattttacatttggctgaccattttacacttctttttcaaatgaccaatcagattttgcaattttctagttaattcctgtgtttccttcaccattctattttctttttttttttctttttctttttttttttcgggcttcttcttcttcttcttcttcttcttcttcttcttcttcttcttcttcttcttcttcttccttcttatatttaatgcactgatttcttctaatgttttgtaacttgggtattaaaaggtgtaatttaaaatgagaaagcagtttctacagagtccttagaaatatgtcattttaagtccccattttcattatattctaaggagctcgaagatatacttttgattcttttctaaactgtgcattcgagagttaatctcttcttgtttacttttacgttcattctttcaatgttattttctaatttttgtgtatcattttgtttatcaacacataaatatgtacattcacataagtatacgagttatatatacatgtatttatgaatggcagctgaaccacacattagtgctaatattggtgactaaaagttggagaaccagacattatgtacctcataaagcgaagcaatggaaagtgcacaagcccacctatcaaattgtcttgttaaaagatttgaagctgaatctaagtgagcctctacttgtaactaccagtttacaagaaatagagtaggtgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgttaaaaaaaaaaaaacccaggatgtataacacaaagagcaaactgtaatgtaaactgtggacttcagttaacaataatgtattagtaattactggtttaccagttgtaacaagtgtaccatactgatgcaagatgttaataatagggaaaattgtaagagaggtagagtgatggagtttatggaaattctatctattctggtcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaaagttaatattagatcatatttatgatctattaccaatttgttaacaacaagtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggacgtggtagcgcacgcctgtaatcccagctactcgggaggctgaggcaggagaatcgcttgaacctggaaggtggaggttacagtggatcgacatcgcaccactgcactctcaaaaaaaaaaaaaaaaaaaaaaaaagtctttattgaaagtttcaaacttaaaagtgctctcacatataaataaaatcattttctctatatacatggtttttgcaagtgtacatgtctagacaccctaggaatggtggtgccgtggtgtgaacgtggagcctggaatggccagccccaaaacctcctcctcatcaactgttgactcgtcaacagtcagtcagtaatcaaaacttccttaaaatacaaagagccgcagaacattccgggatatctgtgctacttaatctggcagttcctactgtgtcttgcccccggtgtgacgtgctctcttccatgaaattaataactgcaaactgtaatgggaacaatgcaattgattgtctccgcactcttgcccaaagcgttctctgagatgtttggtagttatttgggtccttacttgaccttcgtggccttaaaacaaagggaacatggcatttgtgaatctgaaagaattgtgataattttctcatttcctcctggctgtgtgcatcaccctgagtttgcggagggatcagccctttttcagagccccctcacgtcctgagtatcatcctcagaatgtggggcttgggctcaatttgaagagggtgtgagggagagccaaaatgcagggattgtcccacagtgcagtcctgctttgtaaaccccttcctctgactagcttgattttagtctctgagaatggatggggtgggatggcttttcagtactttctgctgagacatttttgtatattcatttctctctcaaggagcctctgtaacaaaagagaaaaaactgtctcgggttctgtgtgtggcacatgagtttgaaggatttctgagactattgttcaggactggcgttacagatgaaatatagattcaggaccagtgacggtgggatccttggcaggcggacataacgcctcgttaaggacagactgcccaccactctctttctttctttctctctttccgaaatcattttctataaattccactgggtatcagaaccttccttaggctgactggcgcttcgcagtctcctctccaagcccggatctattccccaaaattctctcgttcatgcttctagcttctcttcttagcttctctaggttcgcgtcatcggctttccttgtttcccaggttgaatccccagttccaagcggctcctgtaacagggagtgggagcccaccctcccactcgccgtgtagcactctgcatctctgagaagaaagtgaccaccccagcccagcacagattttcttcgtctttgagcacctgctcggagttcccgcccctcgtcgctccttggttttccctcattgcctacatagagtctgttggatgtcggtcaaggtatccccagcccctgccgtgggaaccgtttggggaaaaacagacctgatttatttatacttcaaagatgcccaatgattccctgtcgtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaagtgagcgggttacaaattccgctaaccccagcccgccaccccgctattggctatttgaggcatgtgggggatttttccggactagaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaaggtaagcgttcacttgcaaaagctgccctctctgaggctcgaactcaggaccttcagattatgagactgacgcgctgcccgctgcgctaagagggcgacgaagtgcatcaacgcgccagcttccacaggaatttcctaatttctttccccaggcgggttattttgggacttcagttttcttcgcccaaggtcgctagttttccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctctcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaataccctattaaagattttattcccgtaatttcatttagtccaatttatttatttatttatttgccataaatctatacatcattatccccatcttactgatgaaactgaggctcagcagaactaaatccacagctgataaggggcaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacctgccatgtacccggcatttatgctctagatttccaaggcatccttggccctttatccctcacatccctacaaacaccttaaatcattagttctcgaagtgcggtgcccagacccaccacataattctcgaggacacattccatttcaggtactgtgctacccgaaggctttgaggattcagaggaaattgagccatccctgacctcaggagctgacaggacaaactgtcctatctggtccggttcctatactctcaaacttccggattcttataaatgcatcttcctaaatattttattttgatactgtaactcccattctgcactagtttgctagggctgccataataaatatcatagactgagtgccttaaccaacagaaaattttctcagttctggaggctagaagggttgttagctttggtttctcctgaggcctctctccttggctcgcagatggtcacttaccttcttgctatattctcccacggtctctctctctacacatgtttccatcttttcttataagaactcctattgggagttagggtttcgacatgaatttgatgacaggtggggcgggacaaaattccaccatgacaggctcaaagttgtttacattttcaccctcatatttgcagtagactttgttactggaaaacactacttgcttttttttttttttaacacgtattttaaagccccttaattaaacagaccatatacctttccttatctaggaattcccattccagtgcctggtccacacatccattatttctcctcatctccattcctcaaggcccattcttgattctttcattcttatttgaaagaatgtagcatggaggaatgtagcatactagtttttccctcggaattgcatgactcattgtcatgcaaattacgcagtctcaggtgttccttttagcaacacaaagtagactaaggtgtgtacatttttgtacttgtcaaatgtggttagaataccaaatgaggtactgcctcacagatccctgagatgtcattacttggcataacaaaatcataatatagatatcataataatgcataagcagacaggaaaaaaccataataataacaaaactcattaagggatagccacgtaagtttatcagttagttctctctaaactctgtaatatgaatgtggccaatctctgggatttaataatacaaaaaacatgttttggtctcccagtgtcattttaatcttattcagtaggatatattctttccctatctccatatgaagacatacacagttttatgcctcatcccaggcaatacagtctcagtctcaaagttaagatgctgagctccatgtaacactctaaaatttaaacttgacataaagatcagatctcttcctttacctactgggcctgttgagtcagctaaaactatttggatagttttctaaggaaaatgtttcatctctcttttcttaccctaacattctaccatttgttaaccactgttctgagacttccgtgtttcaatcgtggtggaagatgagttaaagccagggaggggtggtggggagaataataaagttcttacttttaaatggtgttgtcattagccagtgtcatgctttccattcagctgtttgaatacgaataatttttttaatacgatccatgattgtggattctcgtgtgcatttcccttgatgatgatgtactctcctgtacccccttctttatgactgcttttccagccactgcaaaactcaaagcttccttttgcttctttttccttagttacgttcatccttccacatagcccactgggactggctcaaagttgacctcatgctagtgctccctctctcctgattcccacacctgtcttgtgggaaaggcctacatctggttgtccctgaaaagccctgggactacaggccaatcccaatatagaaggaacttcaggcagtcaatctgcccatttctcccctttacatttctcatgcatctaactaccgtatctcccatattttggtgccagtgattgaacttgttggcacctgtattagtccattgtcacactgctataaagaactactggagactgggtaatttatgaagaaaagaggtttcattgacccacagtgccacaggctgtataggaagcatggctgggaggcctcaagaaacttacaatcatggcggaaggcgaaggagaagcaagcatgccttaccatggcagagtcggagagaaagagcaaaggggaaagtgttacacacttttcaacaaccagatctcaggagaactcactcattgtcatgagaacagcatgagggaaatctgtctggaacaggtttgtgaacccattgaggtgttcatccagtgctgtttcagagaaatctctatttcaatctattcctatacattagttactgaaaaacaacagacaatcacaaaaacaagttgacctttttgtgatccttgagcccagttgcgaagggccctcgtgaccgggcctcatgccaaacaactcgttacaaaaagagctagggttccagactgggctgaagcttcatgagacttctcctcgtctgtgcgcagacagctggccaactctggagcccaggctgttgcttcccggtctgttggtgaatcctccatagtctggtgagtgtacatatatatgtatatacatatatatatatatatatatatatatatatatgtctttttccttcccattgcaatttgcttattatatcagtctgcttattatttcatttgcttattatatctgcattgccatttacgtgggataaaggttgtttacccttaaaggtgttgtgtgggtgtcttttcttctccctttacatgtcttccacacagaacatgtacacatgtatctacaggtgcatgtgtgtatgtagaagtgattgcacctgtgtttatgtatacatgtctgtgtacaccacatgcatgtgtaaatgtatgtgggtacacgtgcatgcatgtgtatgcatacatgcatgtacacatgcacaaaggtatctacacatacatgtgtatacatgcatgcatgcatgtttatgtatacatgcatgtacaccgtatgtatgtgtgtatgcatgtgtgtattttcagacgcatatgcatatgcatacatgcatgtacttgcatgtgcacacgtagctgcacattcacgtgtgtatgtatacatgtatgtacacgtgtgtgcatgtgtgagtgtgtaaagatatgtaaacatgtatgtgcaaatgcatgtgggtgtgtgtgcatggatgtaggtgtatccatgtattgtgtacacagtatgcatgcatgtatgtgtgtagatatatgtgcagatagacatgtgctcacacgtctgcatgtatgtgtgtacatgtgtatgtgtttacccacgtacgtgtgtatgcacgtgtgtacgcatgcatgtacatgcgtatgcatgtgtgtatgcatgcatgcacatgcgtatgcatgtgtgtatgcatgcatgcacacatgtatgcataaatgtatgcattgtgcacatgtatgcacatgtttgtatgaatgatgtatatatacatacacgtatacaccatgtataccagcctacaaatgcatctgtgcacacacatgtgaaggcgtgtgtatgcctgaatacaagtgtccatacatacgtgtgcatatccacacatacatgtgtacaacacgcatgtgtgcacacatgcatgtgcacacacaaaaattcgtgtgcaaacacatgcatgcatgacatatatgtgtacatggatatgtgggtatacatgcatgtgcatacacacgtgcacgtgcatgcacacatgcacacataatacatgtatatatacatacatgtttgcgtgaaaagcacgatgcatacatgcacacaaacataaatgtgcatacgcacgtacttgtgcatacaaatgcacatgtgtacccatacatgcattcagacgtttgtgcaatgtatacatacacctataagtacatacacacatatacactcatacatgtttgcacacacgcatacgtacacacatgcacgtgtacaaatacatgtgtgcgtgtgcatgcatttgtgcatattcattgattgtgtgcacaatatgtatgtgtgcatgtatgtgtgtatacgtgtatgtgtagatgcatacgtgtatgttaacatgcatgtacactcatgtaaacatgcatcaacacatttatacacgtatttatttgtgtatcaggtttgtatacacgtacctaaacatgcatgcgagcattcgtgcatgtatgtacacgagaatgcatatgtgtatgcatacgtgtatgtacacatataagcacaggcatctacacgtgtgcgtgcgcacctatgtgcacacttatgtatacatgtatgtgcacgtgcataaatgaattaagaaagaaacaattcacccaaacaaggaggaaaagatgaacatctcaagtacctatgagcatttttacatgcagaccccttactgacattggccaagacagatgacaagagatcatcaaggagagagttcattagaaaaagatactgctaacattagagaaacatagcatcaatcacccatagcatggatgctgttgagcttccacctgaaaaacaaacaacaacaacaacaaacctggcgggtagaaataggaacaggtttagcattacatccctccctccttttcctgggacctgcattgggccccataagcttggcatgaacctaagtgaataagacaccaaaggactgaagtttaccactaccttcagaattaggactcagagccaggaatttctttagactacataaccagtctatgcatatgtgaggatttggactgtagttcacactggctgcgcttccttatggaaacagtgactacaagatggaggatattaatgaaagatagcacacatctatactaaatgtcataacagcaaaaaccataagatagttactgacaatgagtcatgcaattccgagggaaaaactagtatgctacattcctccatgctacattctttcaaataagaatgaaagaatcaagaatgggccttgaagaatgaagatgaggagaaataatgggtgtgtggaccacgcaatggagtgggaattcctagataaggaaaggtatatggtctgtttaattaagggactctaaaatacttgttaaaaaaaacaaaaaaaacagcaagtagtgctttccagtaacaaagtctactgcaaatttctttctgtacatgggaaataaggactgtgggattctttgggtggatcccagcacctagagttggatctgatcaaaaagaagtgctcagtaaacatttacctactgctttggttgccttccccctgtggagtgctggcctccaggattgagcttgcatcataggtgttcagtaggaacttgcttagtggatttacaggttgaggttagaacccatcaggattcttttcctggaaagaacaggcatgtgttcttcccttccctctaagttttcacatagacactgggtgaggaaagagccctaaattgcttgaaaaattgattgctctttgagcaaagcaagaaaccctcctgtggaagggcatcatttgggcatatatcggggtctcagtacgaagatgagtgctcaagacgtcaagatgcttaagcagagaatctgaccagaatgttcgtggtacagagaaacagttttgttgggagaaggatgacaattgaggctttcgaatataagctaaataagcttcaaagggtatacaaaaaagaatcaggtacaaatcctttactacattcttttgtacaaatcaatttttgtctagaaaatcataccttactatgcatccctattgtgttcctccaccatctattttgtttttttaagcgttatttcattttcatgttcacagaagcttgttgctacaactacatgagcaaaacagccagtagcaacagaaatgcattaatatctctcctcagacctttaaagcattttccttaaaggtgaacaatattccgcatacaaggactttttcaggactatgtgccagaaattatactgaatgtttcttaattttcacgtaaatcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacatttatgtagtagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctgggggcatatagagccactcagagccttagaggtaccctcagcgaaatggaaccaatcaccatatagtgtagcctattgttcatctgaccaaaatgcactatgttgcgatagcatggattctacagacccgtgaagcccatttggaccacaagacactctttccatcatgcctgcacacatatccctcactcttcattgattcatgcagacttttaaaagtatttagcaataagcatcctacccccaagaagcttatgatctcatggagaagatggccaagcaacagacaatcccgacatggtgaatgccgctaaaacaaatgcttacctggatctccgtgagtgctaggaggaaagcaacccaaactcagaaaagtaggagaggtgtcagggaagacattttccagaagatggtttcgtgtctaacaaagccgtgagacgagcaaaggggaggtgaaaggctcagcgttctatgggacatttccttaattccagtatctctcgagttgagtgtgggaagctaaaagggaggaaatagaaatgaaaaatgggagttcttgagaggctttacttaccctgcacaagccaaggacaggtctgcgggaagtaagcagatgcagttaggaaagcccatatcaggagttagtcacgacagagaaagatttgtacactttggaaatcataaaaggatgaaaagcccaggtccttatttccgtgttttcgcctgtttttcacgttcctcccggatttcaatttctttctggaatctcacctctcctcatcatctgctcttgcaggaacactaaactggaaacgcaaccctacgattcagcgaactatgtcccatcaagattactgggtacaaatacatttactttcgtgttctcttgtgactgtctgtatcactgcacacgtttgttactgtgaaacaagcattaaaagtctgtgtagattactgagtacatatgcatttctttttttttcttttttttttattatactttaagttttagggtacatgtgcacattgtgcaggttggttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtaattctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatggtatctcatagtggttttgatttccatttctctgatggccagtgatgatgagcattttttcatgtgttttttggctgcataaatgtcttcttttgagaagtgtctgttcatgtccttcgcccactttttgatggggttgtttgtttttttattgtaaatttgtttgagttcattgtagattctggatattagccctttgtcagatgagtaggttgcgaaaattttctcccattttgtaggttgcctgttcactgtgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggttttcatggttttaggtctaacgtttaaatctttaatccatcttgaattgatttttgtataaggtgtaaggaagggatccagtttcagctttctccatatggctagccagttttcccagcaccatttattaaatttcttttcttgttctcccgtgacttttgatatcactgcacacaactgttactgtaagatgaacattaaaaagtcacgtctggccagtacggggatcgaacccgcgaccttagcgttattagcaccacgctctaaccaactgagctaaccggccccgcttactaaaaccccccctaaacctcttgagaagtttaaaggcgaacgttatttcaatcaccaaagaaacttttctgaacttctcggaactggaaagaacctgcgatctttgctaacttgtttatgatcctcggcaaatttctccgaaccctgacatttcaattaaaatacaattctgaggaaggaaagttcaaatgtcacctgcttcactgtttcatgacaaggggtttcagtgaccacccttttaaacgcaacgccatcaccttccgccggtactttggcctgcccttctcactcctttctactttgcttccgtagcttctgagcaacccgtgaagaaattgacggaaaacggaaggaattaccgccagtttctttccacgggccgtcaaggccaatataagtccccacccaggctcctctgctcgtaacttccagcacgattcccactgtattagcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacgtttcgaataattaaataaaagaagtctcaaccaacccccttgctgtattacagatggtccagctctctgcctagactattgtgctaatgtcctgttccttctcccggcttttgaactagattctcacctctctccaatccatctttcgcagggctggcctgtctttccgcctcacttctgaaattctatccattgccgcctctgtgcaaaccgactctggttaatacttcagtcggtatggctcccctcttccgcactttgcactgcgagaaatgcccttctttgaggcagctggaggcctcctcctcctgagagcttaattgtggacacagccttgagtagaggcgaaaaggaaagaaggctgggagacaatcggggaaaaacacacacctttggtctggtttgaaagctggcgcccgaaaaggaacaagaaaaaaaacacgcttcggaagtgtctgagattgctgcggccataaagcagagcactaaccctggtactgatacgggaggggagcaagactccacccccgggcctgtgcccatgaacctaggtgaggaggggcacttcttcctccgcgcccaaatgttgcatttcccaagaccaccctggcccgccacgcccccatcctgtgcctataaaaacccccgagaccctagcgggcacagacacaagcggttggacatgaagaggaacacaccggcgggagaacacagaacacccaccctctctttagtcaccctggaggcctcggagaaggcggtttcagtgatccgtgaagagaccctgagtcttttacatcccggagaatgacaagagagtacctgggcgacgtaactttctgggttttccggagatgcggttttctacacgccaggggccaagcctgagaaataggtggacggcaaggacaggagctctctccgcgccacaaacgcccctgctcacacctgggttccttgattttcctgcctatataaccgagccacccatggccgggctccgagctctcattctgcggactgggacaaaggggttaactgtgatgtgctttgtataaccccaggattctgcacttgcccaagggcgaggtgcaaatccaaaatcacgcacgactgaacgccgagatcagctgagtcctgagtgcctcacgacacaaaatccgtatgatttttaaaagcgctgtatttgtgctgacaatgcatgtcagatcccatctgtctttagctcaatgtgtgacgttagacacgtcgttttgctcctcaactttcttatttggaaaaaaaaaaacgagtgttctagatttgcagagggccttttcagagctaagttccagtagctatactgtaagttgaactcgggcagtcctgttggtgaggaaaaaggacaaattgagaaatgaacaaacacagaagttgcaaaagccctgtgacttacagcacaggacaagtctacaaaccctgccatgccacactaagctcaagttgttttaacatcagtttactcagacccgatgatccaaggtaagaccaaagccaaacggatccagcaactgggcagatcttcatgttccagcagctaagttccacggaataaacctatgattcgcctagtttagaaattgtctagtccctcctcagaaggaccttactaactttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcgtttttgtcatatgacattacttgtattttacaggattcacttggtctccatctgacctcctcagagtagactgctctttcccaatcactcctgcaattaccctaggagatatgtgatcctaaagtaacggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaacataaaggcaagtatctttttcactcagttcaccttggttctaagagtgggtctatataaagaaatggaacatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaagtaatcatgttataaacaatatgaacataaaagcaaaaattacatggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctagtgtatccacaaaaataagcattataagtaaatgcagctatgtcacagattacagtatacaaaaattaattgtatttctatgtactagcatcaaaaaaatggaaaattaaattaccactttcaataggtttaaaacaaatgaaatatttagagataaacttgtcagtgtgcacaggacttgtacctaggaatctacaaaagatggctgagaaaaactcaggaaagcttgactaattggtgttgtttgacatatttacagattgaaaaaggtaatattattaagatatcatttttttccctctgagttgatctatagatttactacaatcccaacaaatatcccagcaggagatttttgttttgtttgttttgttttcttttctttttgtttgtttgtttttacagaaattgacaagcttattctgtaggacctagagtaacctaaataattaggaaaagaaaaacaaagttagaggacttacaccaggtgatgtcaagacttattataaagctaaggtaatcaaaataatgtggtattgtctcaaggatacttacccagattgacggaatagaacagatagtccagaaacagaccaacgtatgtggtcaactgatttatgacagaggtaaaatgtttttttaaacaaatggtcccaggcaactgagtatggaaaaaatgattccctacccttacctcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaatataagatgcttatatggccaataggcacactaaaagatgttcaacaacattaatcagtacaaaaatgcaaattaaatctatcaaggattaataggtaacaacagatctcaactcccctgaatggagaaacaattagtaacacagatattagataaagataagttacttgaaggatcaatcagtgaaaagatacttgggcttatttccaggtttgtgttcttaaaaagtgatgcattcaacagagcatttgaggtaactgctaattagggacggtacttccttctctttcatgtaatgggagagtgaaatcagattagaactagtgctttcctaatgagatcttttctctctttctcaggatcaggactcagattgaaaaagcagaggatggtcactgccttccaggtctgaggctgtctcccagaagcttcactcctggcttcgccttggtagggaagtttccggaggtgttcgaaaacctggaaacttaagtgggacataagacgatatttgtgtcccggttataaaaattggcagaaaagacaagtgtagtgtgggggattagctcaagcggtagggtgcctgcttagcatgcaagaggtagcaggatcgacgcctgcattctccagcttcttttaatccctaggctaccaatggtatctggcctagatgacagttgcacagtactcgttattgttgtggcagtatctatgaggattattggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggctatgccgtgaagctctggggctgggagaagctgccccaccacttccgggcggcggtggcggcaaggagcaggtgacgatcacaactctagagcgtgctggaatagctgtgcccccaagccaggcagttccgggtggtgcttctccatccagaatgtgctctctgattccgagagatgaagaaggcgaaattgggaagtgaggagagaggtctccctcatgaccttctttggaaatccctattcttcgcactggcaggctcatagaactttgctgaaggcagtatctgagaagctcggccctcaatctggtcctgccaggggtttggcgacacaaagcaccggcatgctcctaataaccaggaaaatgggtggggtgaaaagtttctcctctggggaattagctcaggcggtggagcgctcgcttagctatgcgagaggtagcgagatcgacgcccgcattctccagtttcttgtctggtttatgtctcttagtttgtattccccgttgtttctcctgttgatgacatcggtgcctcttacctgggagaagatcagaggaaactgccgcctccctagagcccgtgttttattgatccccgtgtaagagtcttgttgcccctgcttccatccttccttcttttccactcctgccacaggtttggcacttctaggtactcaggtgtcagtgcaaatttcccgtctttagacaagtacagctaaaagtgatgcccacacgatctctcagttcctattacatcttcacaaatatcgtctcctccggaaagtatgtctttgaattattggtttgtttttctctcccctagaatgggagcttcctgagtaccgaaacactgtctatgtagactgtgtttaactcacttcatcaccatgtgtagagttaaggttctataaaatacggttactgccttgaacagatgaggtgagtagtataaggaaacggagatcaaacacaaagcaatacttaaaaaaattacctgccacatttctaaaatcttaacaatagcattcactaatgttttttggttttcctttgtgctttctccatagccccttattattattattatcattgacatttgactgacaattttccatttgttttcaaatgaccaagcagattttccaattttctagttaattcctgtgtttccttcaccattctattttctggttttcttttgggctaccgtcttcttcttcttcttcttcttcttcttcttcttcttcttcttcttcttcttcttcttcttcttcttcttcttcttcttcttcttcttcttcttcctcttcttcttatccttttccttcttctgcttctgcttcttcttttcttctttttcttacttcttatatttgatgcactgatttcttctaatgttttgtaacttgggtattaaaaggtgtaatttaaaatgagaaagcagtttctacagaatccttagaaatatgtcgttataagcccccattttcattatattctaaggagctcaaagatatacttttgattcttttctaaactgtgcattcgagagttaatctcttcttgtttacttttatgttcattctttcaatgttattttctaatttttgtgtatcattttatcaacatataaatatatatattcacataagtatacgagttatatatacatgtatttatgaatggcagctgaaacacacattagtgctaatattggtgactaaaagttggagaaccagacattatgtacctcataaagcgaagcaatggaaagtgcacaagcccacctatcaaattgtcttcttaaaagatttgaagctgaatctaagtgagcctctacttgtaactaccagtttacaagaaatagagtagatgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgtttaaaaaaaaaaaacccaggatgtataacacaaagagcaaactgtaatgtaaactgtggactttagttaacaataatgtattgataattactggtttaccagttgtaacaaatgcaccacgctgatgcaagatgttaataatagggaaaattgtaagagagggagagtgatggagtttatggaaattctatctattctgatcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaagttaatattagatcatatttatgatctattaccaatttgttaacaataggtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggatgtggtagtgcacgcctgtaatcccagctacccgggaggctgaggcaggagaatcgcttgaacctggaaggtggaggttacagtgaagcaagatcacaccactgcagtctcaaaaacaaaaagtgtttattgaaatttttaaa

SEQ ID NO: 178 - DNA, 57389 bp, Homo sapiens
ggttcttttaaaattcctttgatttttttttttttttttggcctgtttttcaagtgtccaatttttgtcacccttctcccatcaggtcagagagatagccaatggtcagaagcaatcttccagcaactgccatagcgctttctcctgcctgcagatgcctctttttagtcagcctttatgggaagtagcagcaccatccgttcccagagagcaagctctggagtagctgagctaaccccagttgctaatctgagctaatcccagttaccccagtggatttacagattgagggtagaacccagcagggttctcttcttggaaagaataggcttccctctaaggtttcacatagatactgggtgaggaaacagccctaaatggcttcagaaattgaatgttctttgggcaaagcaggaagccctgctgtggaagagcatcatttgagcataaatcaggttatcaggacaaacagagtgttcaggaggtctagatggttaagcagagagcctcatcagaatatccgtggtgaagagaaacaatcttgctgggagaaggataaccgtaactggggacttagaataaaggctaaaaatgattcaaagagaatgcaaaaagaatcaggcacaaatctttactatattctgttgtgcaaatctcaccttactatgtgtttatattctattcctccacaatctttattttatttttatgttcacagagacttgctggttccaactaaatgagcacaacagccagtgacaacagaactgcacttaaatagtccctcatcagctcttgagagcagattccttaaaggtgaacaatattccacatacaaggacttttcagcagtatgcattagaaatggaactgaatgtttattattctttatataagttggttgatacgacttttcagcttccctcagtaacattatctaaattttgtagatgacagtaaagctcagaggagttaaaccattttcctcaaatcacgtagctttaaacaggaaaaccagatatgaaaagcagatttctttctaaattaaaaaacaaaaacaaaaaaacttgagctcttgctttaccctagcacatagtctcgccatctgttttctccacaccaggtcattcatgtaacattcattcacataacaaatacaaataaatgagcggattcattcatcagatattaattcagaatctcttttgtgtctaccacactaggctcaagacgtcccagtgtctttgtctcctctccctcaaatctctccacccaatatcttgacaaataaagtagatccttcctgtacaacgtctccagaatcttttcttccttttctttcacctctgtcatcattcatgctacagtgtttacggaggatgtgttctgcagcatgaagtgtcgtgggcactagctctgcagaaagacttctgctgtccacctcaggtgctgacatgataaatgtgggtaaacctcaatcctttaatatctttatgacttctttccctttctccccagttcctgttttctcatgttcaagctctgacattcaaaactaaacacctttctctaacatgttgctttaattatttaagcattctgcctgggatattttcagttagtcatgggatttttcataaaactctcccaatatatctccaagtggccaggcttttcaatcactgcttccctccatgtgtatttcacacacacacacacacacacacacacacactctccacttaaattgaacaggtttatttctttacacaagaattcttacaaacagcccggttttctccaccatatgtccactccttctctgcatagctcaattttgattcttacactatattttacatattcttacactctgatacgatcttgtctcttattctttatggctctgctctgtaattttgttgttgttgttctgaaatatagttggacatgtaacttgtacatgacacaccttagcaaggaggcaactcatatctcagatgtaagtgaaagaagcactctccaggggtttcctatgggagtggtcagcacgctggcctcattggtggaatggcctagttacgaaaacagcaggagctttttgccttccagaaatctggaccatctcacaacccccagacagtctcagctacaaggaaaagtgataattccatcccacttttataaacacacacaaacacacacacacacacacacacacacacacacacacaatcatttaatcatttttaatcatttaatcatttttttaaaatctctgacactttagctgggcaggtctagacatgtcctcctttgctgggatgtgcctttttctgtcccggaataccctaaacttgacattttggcagcacgagttttccctttgtgactttctccttgttccctttctcctccttctttgcagagaatgagtagccactgcgccttgccctgggccatcagtgagaagacctgctcttagtagagccctgctttcccgctgaaggccttgaaatcccctgtgttccaggacacccactaaagatcaagaaagctcccctgacgtggggaattagctcaagcggtagagcgcttgcttagcatgcaagaggtagtgggatcgatgcccacattctccaagctttattatttggaccttgggtctccaaacactcaagtatccaaacccaagttagtgtctgagagcaggatgctgctttggttcaagacataggagcagcaacaatacaggcctggtgatggctccctcctggcattcagtatagtgtagatctactgtgtaattcatttgctgtttcctcaaggagctgtgaaaccaagggacatatacaactgctcttttctccctgtttctgcctgcagcttggtcctaaacctcagacaatcgtgaaatgtgcagggcagagccacctgggtaaacacagcctcggctttctgctcaggggactgaaaccaggatgtgtcaagtaactagaatgtgcctggacagatactgtagaaagcaaacccataaagttgttcatgagcttgtggacacacctgccagctgtgaataagtggctctaatcccaaacaacttacctacaaagagcctgagagctgaactgcgcaatggcccactttccagtcctcactgaagttgcacacactccggaaatctctgaacagtggcgtaaaggctttgcaaatagagttatctttgaaacaacaacacgtggaaggctggttggtacttggaacttgaatacaaggcaattttgtgcctgcaaaaacaaaaatagcaatattattcttaagatttcaacaaaacacagtgtctcatcacataatccaaagaagtccaggttacaagccccaaaatcttcggcattatgaaaaaaacagggagatcttcattcacatggcaaagagactcctcgaataacaatactgagaggacacagatgtcaaaatcatctgacgcatacagtggagcagttatgataacaatgctcctagaattaggggataacattcgtgaagtgaatggaaagttggaaagtctcagcaaatatctggaatatataaacaccaattttaagcttaagaatttaaaaaaatgtattaaccaaaactcttaggggaaataaaaagcttaactggatgatctcgataacagaatgcagatgactaagaaaaagtcaacgaacttgaaaacagaacaagaatacctacataatctgagctatagagagaaaggagtatttctgtaaatgaacagaggctcagggacaaattaaaaaatagcaaatctaacattcacattattgtaatctgaaaagaagaggacaaagaggtctttgtgggataaaactttgaagaattaatggctgaaaatgtatcaaatttgtcaaaagatataaaccaggtttttaaagttcagcaaaggtcaagcaggataaacccaaagaaacccaacccatttcaagacgtatcataatcaaactgctgaaaacgaggaaagtacaaaacaatcttgaaagcagtcaaaggaaaatgaaaaagaaactaccatatgaatgagtgtagatttctcatcaggaaccatagcggccagaaaaaaatgtcataatgttcagtaagtaacaaaagaaaaagacctatcaacccagaatgctatgtggagcaaaagtatctttcagacataaaggcaaataaatgcattctcattggaaggtaagtcaatacattctcattcttagcaagaatgctggaaaagaattagcaaagatttgagataagaaaagtgataccagaaggaaacttagaacatcgtcaatgaaggaacgaaagcagaaatagaaaatgtctgggtagacataacagactgttcttcttctcctgagttccttaaggtatgtttgatgattgaaagccaaaattgtaactttatcagaagcagttgtcattgtatcgagatgtactacatagataagataaaagggtaagtgtaatgggcctaactcttgatgaagtttctatattcaacttgaatggtaaaatattgattctaagtatactgtgaaaagttatatacgtatatggtaatccctagaccacttactaaccagattgaaataaaccaaaacaagatagacagaggaacatagaagaattaaaacaaagggaacaaaggttaatacattattaaatagatctatctaaaaacttatctatattaacattacacgtaaatgatctaaatccttaattaaaaactagagatcatcagaatgtattaaaagtaaatatgctgactgtaagaaagccacctgcaatacacttatatatcagaataaaagttatatagcagattgaaggaaaagagtgggaaagatacctcatgcaagcattaatcaaagacagctgtggtgtatacattaaaatcagacaaagtagatttgaaagcagagaaacttttcaggaataatgaaggctgctagataattacgaatgtccattctccagggaatactgttccaaatgtatatgaggacacagattttcaaaactcataaacaaaattagataagccaggtaaaaatagaaatatccaattttagttgaagacactaaaactcctctctcagtcattggtagacttagtagacaacaaatcagccaacatattggagaactgaaccacaccatccaccaatggatctgatcaacttcataacgcaaaataaaaatttagccagaaagcaaagacaaaaattaaaagaaaagtaagatcatgttataaccaggaaattaagagtggtccatcatatagaagggtgctattattgaaagagtttgaaatagtgacttagttattttgaaagagttttgaaggcattatttagctggaaatgacagaaagactgaaaatggtgaatctggaggtggatcttccctcatctatatttatcttgttttcttttgaggtctagggtgtctatacttcctctgaattacctgatcctactacagtgtctggcacagagcatctccccagtgaatatgtactaaatgagtggaaagtaattgatagattcaaaagagttgtgcaagaataatgttcattatttggcaaatcattgaatgtggtgtttgatggaagacaatgaatcaaagttgacttgaaaggtaagcccaaggccagacgtggtggctcatttctgtaatcccagcactttgggaggccgaggtgggcagatcccttgacgccaggagtttgagaccagcctgggcaacccagtgaaatcctgtctctacaaaaaaaaacaaaaattagccgggtgtggtggtatgcatctgtagttccagctactcaggaggctgaggtgggagcatcactggaacccgggaggcggaggttgcagtgaacagagatcacaccagtgccctggcagtaaagtgacaccttgtcttaaaatgaaatgaaatgaaatgaaataaaataaaataaaataaataaaataaaataaaataaaataaaataaaatataaaagttaagcccaggccgggcgcagtggctcgcacctgtaatcccagcactttgggagaccaaggcaggcagatcacctgaggtcaggagtttgagaccagcctggccaacatggtggaaccccgtctctactaaaaattcaaaaactagcggggcacctgtagtcctagctactcgggaggctgaggcagaagaatcacttgaacccaggaggcagaggttgcagtgagccaagattgtgccactacactgcagcctgggcaacagagtgagactccaactcaaaaaaatttttaaaaaaaatttttaaaaagttaagcccaaaaggtaagtaaagaggaggtctggaattagatatttggtgtatgagtgaatgagctaaagtgcaaaagaatgggcagaataaccgtgagctggagcagagggaaaaaaatcacatgcaaaatctaaaaatatctgcttctcaattcgggctttcccacttagcagctttggcatttaaaaaaaaaaaaaaaaaaaaaaaaacacttgaccgggcacggtggctcacgcctgtaatcccagcactttgggaggccgaggcgggcggatcaggaggtcaagagatagagaccattctggctaacacggtgaaaccctgtctctactgaaaaaatacaaaaaaattagccgggcatggtggcgggtgcctgtagtcccagctactcgggaggctgaggcaggagaatggcctgaacctgggaggcggagcttgcagtgagcccagatcgggccactgcactccagcctgggagacagagcgagactccgtctcacagaacaaacaaacaacaaacaacaacaacaaaaacgcacttagcctatctgattctctattacttctaaaaagtgcatactaaggcataattttgttggcaaaagtcaatcagactacatcaagtaaactccctaagtctcctagtataattcacggcacaaaaatatgaggaaaaacagggaggatatgattaaaagtttagtttgtattttttgttgagtgaatgtctccagtcatagagatgcaagtgtagatacacagtaagagtagtatgaatggcagacaccttggaaggctatttcttccttcattcattcagttggtcactcaatgaactatcatgaattgagcactacctctgtttcttatcaacaaaggagactacggaaaggaagaatgactaagatctctgaagaagggaaaagctagatgactgggccacaagaggaaaaaaagcagcaagacaggtacaattgtgtctagtccctcaagccagaaggtcctatcattatgtgaatactggaaacgggtggactccacctgtcctgagtggggaattcttccagtgcagcattgactgataaggagtgatttccaagtagcattgattgtgttctttaaaagctaggaattgataaagcagcagtgcgtgggaaatgagatttaataatctggatgtcacctcttaggaacagttgctctcttagagcagcaggccacctgtcaatctcgtattctgaaggtcctgagtttgaacatgagacaaggcacagcttatgccgctatttccattaagagaaatgaaataggtgtgataaataatggaacacaaatgctatgagataatgatttcaagacagaccaaatattagcttaaaatttaaaagtgagttttcttttcttttctttctttctttttctctttctttctttctttctttctttctttctttctttctttctttctttctttcttccttgcttccttccttccttctttccttccttccttccttccttctttcctttcctttctctgtctgtctttatttattttttccttcttttggcttctcagtcgcttgagtacaaggcgtggtgaaggcatataaattacaccagaaactgcaagctatgtcttatgtctacctctctagctgacaggggaggcaggggaaatttctcttccaattgcctgctctgaaggtcatccaaacataattatggggtggggtgggtaaagtcttttattcttttaatcgtccaaccgatagttctcaacacatatcttgttaagagactgttttgggtatagcaattcgcagtgaataaaatacagatattctcacctttgtgatactacgtcaatgttggggggagtggggagaaagagacagaagcaaaaaagaaaaataaacaagaagtcatgtgatattatctactgggagggagtcattaggcagtaaaggactcggcagtgtggaggtgacacattcacttttcaggagaagaatcagggaagttgtcaccttgaagatatcatttagcttccctttcttccaatagtctttctttacatgggaaatgaggactctaggattctccggctggatctcagcacctagagatggatctgggcaataggaactgctcagtaagcattacctactgctttggttgccttctccctggcctcttggattgagcttgcatcatacgtgttcagtaggaacttgcttagtggatttacaggttgaggttagaactcaccgggattctcttcctggagagaacaggcttccctctaaggtttcatatagaccccgggtgaggaaagagccctaaatggcttgaaaaattgaatgctctttgggcaaagcaagaagcgccactatggaagggcatcatttgggcctatatcagggtctcagtacaaagatgagtgctcacgtggtcaagatggttaagcagagaatctgaccagaatgttcacggtgcaaagaaataatcttgttgggagaaggatcacaacaattggggaattagaatacaggctaaatgagactcaaaaataatacaacaagaatcaggcacaaatcctttactactacattcttttgtacaaatccattttgcctagaaaatcataccttactatgcatccctattgtgtttctccaccatctattttactttttaaactttatttcatttttatcatcacagaagcttattgctacaaaacaaatgagcaaatcagccaatggcaacaaaactgcactgatctctctccttagaccttcagaacattttccttaaaggtgaacaatactccacgttcaagaatttttcagctctatgtgctagaaactatactgactgtttattaatttttatgtaagttggtcgatatagtttttcagcttccccaagtattattaccctagtgttacagatgacactgaagctcagagcagttaaaccattttccttagatcacataactttaaagagggaaaccagatatgagaagcagatttctttctcaatgaaaaaaatcacaagctcttcttgctttagtctagcacatagtcttatcatctattttcttcacaccagctcactcatgtaacattcattcatttaccaaatacagataaatgagtggatttattcttgcatcgatcagatatgaattcaaaatctcttctgtgtctgccacaccgggctcaagacttgccagtgcctttgtctcctctccctcaaatctctccacccaatgtcttgacaaatactgtagatccttcctgcataaactctgcagaatctttttcttctgttttactcacctccttctttatccatgctatgatgttcatggaggatgttttcttcaccatgaagtgtgaaggggattgaagctgcagaaagactcatgctgttcacctcaggaactgacacagtcaatgtggataaatctcaatcctttaatatctttatgacttctttctctttctccccagatccagtttttccattttcaagttctttgacatttaaaactaaaaacctttccctaaaatgctgcttttctacctggaattttttcaatgagtctttagcttttataatattctcccaacatatctccaagcatccaggcttttcaatcactacttccctccgtgtatattttacacacacacacacacacacacacacacacacactccacttaaattgaacaggcatatttctttacacaggaattcctacaaacattccaccctatacctaccctaggttttctccaccctatgtccactctttctctgcattgctgaatgtgttttctttattctttcactctgatatgatctttgtctcttattctttatgcctcttatctgcatttttttgttattattgttctgccatgcagttggatatgtaacttttacatgacacaccttagcaagaagacaacacatgtctcagatgtaagtaagaaaaacactctccagggatttcctggtgtagtgctcagcaccctggcctcattcctgaaagtccctcggtgtggaaaaagcaggagctctttgccttccagaaatctgcatcatcccacagcctcagctacaagaaacaagtgacaatgccatctcttttcttttaaaaaaatcatttaagcttcctgagatatctgtgacacattagctgggcagggtccttctgtgggacatgtcattttccgtctcggaatatgtgaaacttgacattttggcaacaccagagttttccctttgtgactttctccttgttcccttttctcctccctcctcacagagaataagtacccactgcactcttgccctgggccatcaatgagaagatctgctcttagtggagccctgctttcgcggtgaaggccttgaagtcgcgtgtgttctagactgcccactaaggatgaaaaaagatgctgtgagatgaagaagtagctcaagtggtggagtgctcgcttagcatgtgagaggtagtgggattgatgcccacattctccaggtttcactagtcggacctcaggtctccaggttacagtggaaaaaaatatgtgttagacactgatctcagaaaacagtaagttagacactcatctcagtagcagcctggacacttctttggctcattatgtaagggcagcaacaatacgggcttgactaagattctactggtatgtggtatagtatagatctatcgatgtgtaattagttttctgtttctttgaggagctgtgatacaaagggacatatccagttgcacttattctccctgtttcctcctgcagcttggtcctaaatgcagcataattatggaaagcgcagggcagagccactcaggtaaatacagccccagctttctgatcgggagaccgaaactaggagttgccaagtaaccaggaaagacactgtggagagcaaacctgtcaagttgtatgtgaactcctggatgcgcctgtgagctgtgaataagtggctctgatcaaagacaacttatctaaaaagagcctgagaatcgaactaagtgatagcctactttccagtcctcactggccactgggttgcacatactccagagtctctgaatagcagtgttaaggctttgaaaatagaatcgactttgaaactacaacacacaaggctggctggttattggaacttgaacacaaggcaatcacatgcctgcaaaaacaaaaatagcaatattatccttaagatttcaacaagacacagtgtctcatcacataatgcaaagtacaaccccaaaatattcagcatatgaagaaccagggcaatcttaattcacttggcaaagagaatcctcgaataacaatactgagaagacacagatgttacaatcatctgacacatacttttaagcagttattacaacaatgctccatgaatgaaaggataacactcttgaagtgaatggaaagttgggaagtcttagcaagtatctggaagctctaaacactgattttaaacttaaaaattaaaaaatgtattcatcaaaactattaggagaaaaaaaacttcaatgggttatttcaataacaaaattgagacactcagaataaagtcaatgaacttgaaaacagaacaaaaataccaacctaacctgaacaatagagaaaaaggagtgcttttgcaaatgaacagagcctcccggacaaacagaaaaataagaaaaatctaacacatcattgtaatcctgcaggaagaagagaaagaggtcctccagaaagaaaactccgaagaattaatggctgaaaacatatcaaatttatcaaaacactttagaagttcaataaatgtcaagtaggttaaacccaaagaaatccatacccagacacatcataatcaaactgctgaaaactaaggaaaaccataaaaatcttgaaggcagccaaatgaaaataaaagggaaactgccacttgaatgactgtggacttctcatcagaaaccataggggcccaaggaaacatttactaaataccaaaagaaaagacctgtcaacccagaatgctatgtagagcaaaaatatctttcagactaaaggtaaataaatacattctcacaggaaggtaaactgagagaattcattgctggtagaactgctggacaagaattagcaacgatttaagatgagaaaaatgataccagaaagagacaggacaccatcagtgaaggaacgaaagccgaaatagaaaatgtctgggtagacattacagactattattcttctcttgagttccttaaggtatgtttcatgattgaaagcaaaaattgtaactttatctgatgcagttgccattgtatctagatgtgctacatacataacataaaagggtaaaggtaaagggcctaactgctgatgaagtttctatattcaacttgaatggtaaaatattgattctacgtatactgtgaaaggttatatatgtatatggtgatccctagaccacttaggaaccagatttaaataaaccaaaataaactaggaagaagaacatagaagaattaagacaaggggaacaaatgattaataaattattaaaaagtagatctatcggctgggcacggcgtctcacgcctgtaatcccagcactttgggaggccgaggtggctggatcacctgatgtcaggagtttgagaccagcctggccagcatggtgaaaccctgtctctactaaaaatacaaaaaattagccaggcatgaagccgggtgcctgtaatcccagctacttgggaggctgagacaggagaatcacttgaacctgggaggcagaggttgcagtgaggggagattgcaccatggcactccagcctgggtggcaagagcaagactccatctcagaaagaaaaacaatagatctacctaaaaacttatctataaaaacattaaatgtaaatgatctaaaacaatgaattgaaaaccagaaattgtcagaatgtattataaatgaatatgctgactacaggaaagtcactagtaatatacttatatgtgagattaaaagttatatagcatattgaaagtaaagaatgggaaaagatatgtcatttaggcattactcaaagaaagctgtggtggatatattcaaatcagacaaaccagattttaaattgtagaaaacttccagggataaagggggctgttacataattagaggtgccaacacaccagagaaataatgtcccaaatgcatataaggacacagggcttcaaaactcgtaagcaaaattggataatccagataaaaatagaaaaatccaattacatttgcagacgttaacagtcccctctcagtaactgatagatccagtagacaataaatcagtaaacacatttgagacccgaacaacatccatacagcaatggatctaatcaatcaactttctacagcaaaatcacaatttgggtagaaagaagagaaaaaaaataaaagaaaaacaagatcatgctataactaggaaatcaggaatgttcagggtgcaaaagagtgatatattgaaactgacatttttgaaagggttatttagctgtaaatgacatgacacggagactgaaatcgtaaaactggacgtggatcttcccttctccatatttgtcctgccttctcttgaggtctgggctgcttgaatctttagaatctcctgaacttaccacagtgtctggcacagagcatcttccctgtgaatgtgtactgaatcaatggaaaggaattgacaggttcaaaaatgttgtgcaggaataatgtttactatttcacaaatcactggatgtggtgtttgaaggagaaaaatgtgtcaaaagttgacttggaaacaaagcccaaaaggtaagtgaaggggatttggggaatgagatatttggtgtgtgaatgaatggggtgctgtggagaggagtagggagtaagattgtgaactggagcagagaaagaatcacgttttaaaatctaaaacatcttctcctcagttcaagctttgacacttagcagctctggcaccttggaaacaaaacttatctgaggttccattacttctagaaagtccagattaggacacatagttttgttggtgaaactctgttggactacatgaagtaaattcaataaatctcttagtataattaatggcatacaagatttgctttacactttttgtagcaggattgtctccagtcgtgtagatgcaagaggagatagagagtaagacacagtagtatggacaggagacacctttaaagactattttttcattccttcattcgttcagttggtcagtcagtgaactattatggactgaacatgtcctgtgtgtcttttcaaaaaaggacaccataggaggtgtaagagtgattaagatctctgaaggagggagaagtcagatcactgggccacaagagggaaaaagtcagcaaaacaggtacaattgttcttggcctcttgcctcaagatggtcgtcttgttagatgaatactagaaatgggtagattccacctgtcctgaggataaaattctttgggtgcaggattggctgataaagagtgatttccaagcaccattgattgtgttctttgaaagttaggaactgataaagcagcagtgcttgggaaaatagcacgtgggatgtcaattcttgggtgagaaccgccctctttctgcagcaggccacacatcaatctcataatctaaaggttttgagtttgaacatcagagaggatacagtttttgctgctatttcagttgagggaaacaaaatgggtgcactaaataatgaaatgcaaatgctatgagataacagtttgaagactgactcaacattagcttagaatggaaaagtgatttcggttttttggagtttttttgttgttgtttgtttgttttttggcttgtcagtggtttgagtaaaatgagtggtaaagggatatagattacagaagaaactgcaagctatatcatataattggtctttctcactagctgatggaagaaacaggaaattttttgtcgagctttctgctctcaaggttacccaattgtaattatgaggtgagtgggtgaagtcatttattcttttatcctacatgtatttctcgagcacgtatcttgttaagagactgttcggggtacagccattcaacagtgaaaaaacgcatatattcttcacctttgcgaagctagtttctagttgataggggtgaagagaaacagatcagaagcaaacaagaaaaatacataagatgttatgtgacaacgtctactgggaaggaacccacaggcagtaagggacttgggagtgtggagatggcccattcagaagcttttaggagcggaatctgagaagttgtcaccttgaagacatcctttacccaccctccaccccctccccactccccactcctgctccttccttcaatcatctttcttcacgtaggaaatgaggactgtgggattctctggctggatcccagcacctagagagggatctgatcaataagaactgctcagtaagcattacctattgctttggttgccttccccttgcagagtgctggcctcttggattgagcttgcatcataggtgttcagtaggagcttgcttagtggatttacaggttgaggttagaacccaccgggattctcttcctggaaagaacaggcttccctctaaggtttcacatagaccccgagtgaggaaagagccctaaattgcttgaaaaattgattgctctttgggcaaaacaagaaaccctcctatggaagggcatcatttgggcatatatcggggtctcagtacaaagatgagtgctcaagaggtcaagatgcttaagcagagaatttcaccagaatgttcgtggtacagagaaacagtcttgttgggagaaggatgacaattgaggccttggaatataagctaaataagcttcaaaggggatacaaaaaagaatcaggcacaaatcctttactacattattttgtacagctcaatttttgcctagaaaatcataccttactttgcatccctattgtgttcctccaccatctattttgtttttttaagcgttatttcatttttatgttcacagaagcttgttgctacaactaaatgagcaaaacagccagtagcaacagaaatgcgttactatctctcctcagaccttgaaagcattttccttaaaggtgaacaatattccacatacaaggaggttttcagcactatgtgctagaaattatactgaatgtttcttaatttttacgtaagtcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacattaatgtaatagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctggggggcatatagagccactcagagccttagaggtacgttcagtgaaatggagccaatcaccatatagtgtagcctattgttcgtctgaccaaaatgcactatgttgcgatagcatggattctacagacccgtgaagcccatttggaccacaagacactctttccatcatgcctgcacacctatccttcactcttcattggctcatgcagacttttgaaagtatttagcaataagcatcctacccccaagaagcttatggtctcatggagaagatggccaagcaacagacaatcccaacatggtgaatgccgctaaaacaaatgcgtacctggatctccgtgagtgctaggaggaaagcaacccaaactcagaaaagtaggagaggtgtcagggaagacattttccagaagatggtttcgtgtctaacaaagccgtgagacgagcaaagaggaggtgaaaggctcagcgttctatggggacatttccttaagtccagtatctctagagttgagtgagggaagctaaaagagaggaaatagaaatgaaaaatgggagttcttgagaggctttacttaccctgcacaagccaaggacaggtctgcgggaagtaagcagatgcacagttaggaaagcccatatcaggagttagtcacgacagagaaagatttgtacactttggaaatcgtaaaagaatgaaaagcccaggtccttatttccctgttttcgtctctgtttttcacgttcctcccggatttcaatttctttctggaatcttagctctcttcgtcatctgctcttgcaggaacactgaactgcaaacgcaaccctacgattcagcgaactacgtcctatcaaggttactgggtacaaatacatttactttcgtgagttctcttgtgactttctgtatcactgcccacagttgctactgtgagacaagcattagaagtctgtgtagattgctgggttcacacacatttacattctttttctcttgtgagctttgacgtggctacacataattgttactgtgaaataaacattagaaaagcctgtggcccgtgaaataaacattagaaaagcctgtggcccgtacggggatcgaacccgcgaccttggcgttattagcaccacgctctgaccaactgagctaaccggccccgccggcggaacggaccctacctctcttgagaagtttaaaggcgaacgttattccaatcaccaaagaaacttttctgaagttcttggagttggaaagaacctacgatctttgctaacttggttacgatcctcggcaaatttcttctaacctggaaatttcagttaaaatacaattctgcggaaggaaagttcaaatgtcacctgcttcagtgtttcacgacaaagggtttcagtgaccacccttttaaacgcaacgccatcaccgtccgccggtactgtggcctgtccctatcactcctttctactttgcttccgtagcttctgagcgacccgtgaagaaattgacggaaaacggaaggaattgccgccagttcctttccacgggccgtcaaggccagtataagtccccacccaggctcctctgctcgtaacttctagcacgattcccactgaattcgcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacatttcgaataactgaataaaggaaatctcaaccaacccccttgccgtattacaggtggtccagctctctgcctagactattgtgctaatgtcctgttccttctcccggcttttgaactagattctcacctctctccaatccatctttcgcagggctggcctgtctttccgcctcacttctgaaattctatccattgcagcctctatgcaaaccgactctggttaatacttcagtcggtatggctcccctcttccgcactttgcactgcgagaaatgcccttccttgaggcagctggaggcctcctcctcctgagagcttaattgtggacacagtcttgagtagaggcgaaaaggaaagaaggctgggagataatgggggaaaagcacacctttggtctggtttgaaagctggcgcccgaaaaggggagcgaaaggacaagaaaaaaaaacacgctccgaaagtgtctgagattgctgcggccataaagcagagcactaaccgcggtactgataagggaggggagcagggctccgccgccgggcctgtgcccatggatctaggtgaggacgggcactccttcctccgcggccaaatgttgcatttcccaagaccaccctggcccgccacgcccccatcctgtgcctataaaaactcccgagaccctagcgggcacggacacaagcggctggacgtgaagaggaacacaccggcgggagaacacagaacacccaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgagctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaaaaacaaaaaaaaacaagtgttctagatttgcagaggaccttttcggagctaagttccagtagctatactgtaagttgatttcttgggcagttctgttggtgaggaaagagggcaaattgagaaatgaacaaacacagaagttgcaaaagccctgtgacttacagcacaggacgagtctacaaaccctgccataccacactaagctcaaattgttttaacaccagcttactcagacccgatgatccaagataagaccaaagccaaacggatccagcaactctgcgcagatcttcatgttccagcagctaagttccactgaataaacctatgattcgcctagtttagaaattctggccgtgcgcggtggctcacgtctgtaatcccagcactttcggaggccgaggcgggcggatcacaaggtcaggagaccgagaccatcctggctaacacggtgaaactccgtctctactaaagatacaaaaaaaattagccgggcgtggtggcgggcgcctgtagtcccagctactcgggaggctgaggcaggagaatggcgtgaactcgggaggcggagcttgcagtgagccgagatcgcgccactgcactctagccgggacgacagagcaagactccgtctcaaaaaaaaaaaaaaaaaaaaaaaaagaaaagaaaagaaaagaaaagaaaaagaaaaagaaattctgtccagtccctcctgagaaggaccttactaaccttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcatttttgtcatatgacactacttgtattttacaggattcacttggtctccatctgacctcctcagagtagactgctctttcccaatcactcctgcaattaccctaggagatgtgtgatcctaaagtaagggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaatataaaggcaagtatctttttcactcagttcaccttggttctaagagtgggtctatataaagaaatggagcatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaattaatcatgttataaacaatatgaacataaaagcaaaaattgcaaggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctaatgcatctacaaaaataagcattataagtaaatgcagctatgtcacagattacaatatacaaaaattaattgtatttctatgtactagcatcaaaaaaatggaaaattaaattaccactttcaataggtttaaaacaaatgaaatatttagagataaacttgtcaatgtgcacaagacttgtacctagaaatctactaaagattgctgagaaaaactcaggaaaacctgaataattggtggtgtttgccatatttacagattgagaaatttaatattatttagataactttttttttctctgagttgatctatagatttagtacaatcccaacaaatatcccagcaggagtttttgttttgttttgtttgtttgtttttacagaaattgacaagcttattctgaaggacttagagtaacctaaataattaggaaaagaaaaacaaagttagaggacttacaccaagtaatttcaagacttactataaagctaaggtaatcaaaataatgtggtattgtctcaaggatacttacccagattgatggaatagaatagatagtccagaaatagaccaatgtatgtggtcaactgatttatgacagaggtaaaatgtttttttaaacaaatggtcccaggcaactgagtatggaaaaaatgattccctacccttaactcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaaaataagatgcttatatggccaataaggcacactaaaagatgttcaacaacattaatcagtacaaaaatgcaaattaaatctatcaaggattaataggtaacaacagatctcaactcccctgaatggagaaacaattagtaacacagatactagataagttacttgaaggatcaatcgataaaaagatacttgggcttatttccaggtttgtgttcttaaaaagtgatgcattcaacagagcatttgaggtaactgctaattagggacggtacttccttctctttcatctaatgggagagtgaaatcagattagaactagtgctttcctaatgagatcttttctctctttctcaggatcccgactcagattgaaaaagcagaggatggtcactgccttccaggtctgaggctgtctcccagaaacttcattcctcgcttcgccttggtagggaagttcccggaggtgtttgaaaagctggaaacttaagtgggacatggaacgatatttgtgtcccggttatcaaaacaggcagaaaagacaaatgcggtgtgggggaattggctcaagcggtagagcgcttgcttagcatgcaagaggtagcaggatcgacgcctgcactctccagcttcttttaatccctaggctaccaatggtatctggtaaatactttcagcggatttaccgctctttatttgactcagtttcatcttgttatgtacattttttttttaaggaaattatacatagcattccatgcaaaagcaaaaaaggaagcgattagtcacaagtgagttttgccaatacaggttttggggcttcagctcgaagttaatacaatgtatttttgtggggaaatcaaactttagccttttgggtacaaaatatgaggaacagcctggaaatagtgtcaggaggcaaaagcaggagacttgaatgtgccaaccttttgcttttattcacattgacaacacatggtcaggtagaggatgaaaacgtgtcttctaccagattatctgagagttggccaggctcccaccttcacttatactccttccttacctctctcctgtgtaggtaagagaggtaaggagagaggtaaggaaggagtataagtgaaggtgggagctagcatattaactctagtggtcggatacactctcactaagaaaagtgacatttattccttctattcatctctctgaaagctcgttctgacaaaaatgtgctcaaaataaatggggacctaggtcttcctctaatttccaagatgaaccaaaacgtaaaaaaatgtatttttgaaattgcaacactatcccctatttaaagaaactacatgaggcgctgtattaacaacacatatgttgactagctcaactggcccaagcagagctcagaatgctggagagagtggtctttggatagatgactccaggaagctcttgtaggtccctgggacgtgcccctctttccatccttctttctttcccatcactcaaatctctctctgacaccatttgacttctcagcattgccctttgttaatcgtaatagaaagacaatgttattgattacatgtttttctattttatcttcttattcataaatgatctcaaaaatgaatgtcataaataataaacatgttgttgaatttttgtcccataggagcagcctctttccttctcaggatgtgcactcctaataaactgggaccgtgaaggagggacctgaagctgccccaaaccacctgcagttccatgaaggccatgcctccacccactaatcactctgaaagtagtgcccctccactcttccccaaccacatttccttttcaggcaaaaacatttctatgggtttgttagaccctagcttctaatcctttcttcagtctttactgatctgaagccactctctcctttgaggcttctaaattatctgtatagcctttctccattcagcaaattttcatcaggcaaaaatcctacttgacgctagttatactcagagtaaaataactatgttcctgtcttaaatgagaattcttcacaggtggaaagcagatttggaatccactacaactccaaggcagtggagctaatgtagcctcccctgggctacaggggaagccttcttctgtgggcccgggaattgaagaactagacaggcataagaaggacaagtgtggtgcccaatggagcaagagaaggggggaggaaggtgacagggaagggaaatggcaggagaagcacctacacagcagacacggtatagcctgcatctgtttttccttttggctgagagatccctgagctctgtggtgacaattttccataatttttcatataaaaaatgaagattataaactatttctaggcattttacctgcattactattaatatgtgtacagcatctaaaatagggtctagacggcaattgcacagtactattacttgctattgttgtggcactttctatgtggatcactggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggcgcgtatggcgtgaagttctggggctgggagaagctgccccactacttccgggcggccttgcctgcagggagcaggtgaggatcacagctctagagcgggctgcaatagctgtgcccgcaagccaggcagttccgggtggtgcttctccaactggaacgtgctctctacttccgagagatgaagaaggcgaaattgagaagtgaggagagaggtctccctcatgacctattttggaaatccgtattcttcacactctcaggctcgtagaactttgcccaaggcagtatctgagaagctccgccctcaatcttgtcctgccagggatttggcggcccaaagtaccggcaggctcctgataaccaggaaaatgggtggggggtggtgtatcctcagtggggaattagctcaggcggtagagcgctcgcttagcatgcgagaggtagcgggatcgacgcccgcattctccagttccttgtccggtttatgtctcttggtttgtatacccgcttctttctcctgttgacaacggcggtgcttcttacctgggagaagatcagaggaacctgccccctcccccgatctcgtgttttactgctccccatgtaagagtcttgttgcccctgcttccatcctcccatgttttccactcctgccacaggtttggcacttctagctactcaggtctcaatgcaaatttcccgtctttagacaagtacagctaaaagtgatgcccacacgatctctcaattcctactacatcttcacaaatatcgtctcctccagaaagtatgtctttaagttactggtttgtttttctctcccctagagtgggagcttcctgagtaccgaaacgctgtctatgtacactgtgttcaactcgcttcatccccatgcgtagagttaaggttctgtaaaatacggttactgccttgaacagataaggaaacagggagatcaaagacagagcaatacttaaaaacattatcctgccacatttctcaaatcttaataatagcattcactaatgtttttggtttttctttgtgctttctccatatccccttattattattattattttacatttggctgaccattttacacttctttttcaaatgaccaatcagattttgcaattttctagttaattcctgtgtttccttcaccattctattttctttttttttttctttttctttttttttttcgggcttcttcttcttcttcttcttcttcttcttcttcttcttcttcttcttcttcttcttcttccttcttatatttaatgcactgatttcttctaatgttttgtaacttgggtattaaaaggtgtaatttaaaatgagaaagcagtttctacagagtccttagaaatatgtcattttaagtccccattttcattatattctaaggagctcgaagatatacttttgattcttttctaaactgtgcattcgagagttaatctcttcttgtttacttttacgttcattctttcaatgttattttctaatttttgtgtatcattttgtttatcaacacataaatatgtacattcacataagtatacgagttatatatacatgtatttatgaatggcagctgaaccacacattagtgctaatattggtgactaaaagttggagaaccagacattatgtacctcataaagcgaagcaatggaaagtgcacaagcccacctatcaaattgtcttgttaaaagatttgaagctgaatctaagtgagcctctacttgtaactaccagtttacaagaaatagagtaggtgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgttaaaaaaaaaaaaacccaggatgtataacacaaagagcaaactgtaatgtaaactgtggacttcagttaacaataatgtattagtaattactggtttaccagttgtaacaagtgtaccatactgatgcaagatgttaataatagggaaaattgtaagagaggtagagtgatggagtttatggaaattctatctattctggtcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaaagttaatattagatcatatttatgatctattaccaatttgttaacaacaagtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggacgtggtagcgcacgcctgtaatcccagctactcgggaggctgaggcaggagaatcgcttgaacctggaaggtggaggttacagtggatcgacatcgcaccactgcactctcaaaaaaaaaaaaaaaaaaaaaaaaagtctttattgaaagtttcaaacttaaaagtgctctcacatataaataaaatcattttctctatatacatggtttttgcaagtgtacatgtctagacaccctaggaatggtggtgccgtggtgtgaacgtggagcctggaatggccagccccaaaacctcctcctcatcaactgttgactcgtcaacagtcagtcagtaatcaaaacttccttaaaatacaaagagccgcagaacattccgggatatctgtgctacttaatctggcagttcctactgtgtcttgcccccggtgtgacgtgctctcttccatgaaattaataactgcaaactgtaatgggaacaatgcaattgattgtctccgcactcttgcccaaagcgttctctgagatgtttggtagttatttgggtccttacttgaccttcgtggccttaaaacaaagggaacatggcatttgtgaatctgaaagaattgtgataattttctcatttcctcctggctgtgtgcatcaccctgagtttgcggagggatcagccctttttcagagccccctcacgtcctgagtatcatcctcagaatgtggggcttgggctcaatttgaagagggtgtgagggagagccaaaatgcagggattgtcccacagtgcagtcctgctttgtaaaccccttcctctgactagcttgattttagtctctgagaatggatggggtgggatggcttttcagtactttctgctgagacatttttgtatattcatttctctctcaaggagcctctgtaacaaaagagaaaaaactgtctcgggttctgtgtgtggcacatgagtttgaaggatttctgagactattgttcaggactggcgttacagatgaaatatagattcaggaccagtgacggtgggatccttggcaggcggacataacgcctcgttaaggacagactgcccaccactctctttctttctttctctctttccgaaatcattttctataaattccactgggtatcagaaccttccttaggctgactggcgcttcgcagtctcctctccaagcccggatctattccccaaaattctctcgttcatgcttctagcttctcttcttagcttctctaggttcgcgtcatcggctttccttgtttcccaggttgaatccccagttccaagcggctcctgtaacagggagtgggagcccaccctcccactcgccgtgtagcactctgcatctctgagaagaaagtgaccaccccagcccagcacagattttcttcgtctttgagcacctgctcggagttcccgcccctcgtcgctccttggttttccctcattgcctacatagagtctgttggatgtcggtcaaggtatccccagcccctgccgtgggaaccgtttggggaaaaacagacctgatttatttatacttcaaagatgcccaatgattccctgtcgtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaagtgagcgggttacaaattccgctaaccccagcccgccaccccgctattggctatttgaggcatgtgggggatttttccggactagaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaaggtaagcgttcacttgcaaaagctgccctctctgaggctcgaactcaggaccttcagattatgagactgacgcgctgcccgctgcgctaagagggcgacgaagtgcatcaacgcgccagcttccacaggaatttcctaatttctttccccaggcgggttattttgggacttcagttttcttcgcccaaggtcgctagttttccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctctcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaataccctattaaagattttattcccgtaatttcatttagtccaatttatttatttatttatttgccataaatctatacatcattatccccatcttactgatgaaactgaggctcagcagaactaaatccacagctgataaggggcaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacctgccatgtacccggcatttatgctctagatttccaaggcatccttggccctttatccctcacatccctacaaacaccttaaatcattagttctcgaagtgcggtgcccagacccaccacataattctcgaggacacattccatttcaggtactgtgctacccgaaggctttgaggattcagaggaaattgagccatccctgacctcaggagctgacaggacaaactgtcctatctggtccggttcctatactctcaaacttccggattcttataaatgcatcttcctaaatattttattttgatactgtaactcccattctgcactagtttgctagggctgccataataaatatcatagactgagtgccttaaccaacagaaaattttctcagttctggaggctagaagggttgttagctttggtttctcctgaggcctctctccttggctcgcagatggtcacttaccttcttgctatattctcccacggtctctctctctacacatgtttccatcttttcttataagaactcctattgggagttagggtttcgacatgaatttgatgacaggtggggcgggacaaaattccaccatgacaggctcaaagttgtttacattttcaccctcatatttgcagtagactttgttactggaaaacactacttgcttttttttttttttaacacgtattttaaagccccttaattaaacagaccatatacctttccttatctaggaattcccattccagtgcctggtccacacatccattatttctcctcatctccattcctcaaggcccattcttgattctttcattcttatttgaaagaatgtagcatggaggaatgtagcatactagtttttccctcggaattgcatgactcattgtcatgcaaattacgcagtctcaggtgttccttttagcaacacaaagtagactaaggtgtgtacatttttgtacttgtcaaatgtggttagaataccaaatgaggtactgcctcacagatccctgagatgtcattacttggcataacaaaatcataatatagatatcataataatgcataagcagacaggaaaaaaccataataataacaaaactcattaagggatagccacgtaagtttatcagttagttctctctaaactctgtaatatgaatgtggccaatctctgggatttaataatacaaaaaacatgttttggtctcccagtgtcattttaatcttattcagtaggatatattctttccctatctccatatgaagacatacacagttttatgcctcatcccaggcaatacagtctcagtctcaaagttaagatgctgagctccatgtaacactctaaaatttaaacttgacataaagatcagatctcttcctttacctactgggcctgttgagtcagctaaaactatttggatagttttctaaggaaaatgtttcatctctcttttcttaccctaacattctaccatttgttaaccactgttctgagacttccgtgtttcaatcgtggtggaagatgagttaaagccagggaggggtggtggggagaataataaagttcttacttttaaatggtgttgtcattagccagtgtcatgctttccattcagctgtttgaatacgaataatttttttaatacgatccatgattgtggattctcgtgtgcatttcccttgatgatgatgtactctcctgtacccccttctttatgactgcttttccagccactgcaaaactcaaagcttccttttgcttctttttccttagttacgttcatccttccacatagcccactgggactggctcaaagttgacctcatgctagtgctccctctctcctgattcccacacctgtcttgtgggaaaggcctacatctggttgtccctgaaaagccctgggactacaggccaatcccaatatagaaggaacttcaggcagtcaatctgcccatttctcccctttacatttctcatgcatctaactaccgtatctcccatattttggtgccagtgattgaacttgttggcacctgtattagtccattgtcacactgctataaagaactactggagactgggtaatttatgaagaaaagaggtttcattgacccacagtgccacaggctgtataggaagcatggctgggaggcctcaagaaacttacaatcatggcggaaggcgaaggagaagcaagcatgccttaccatggcagagtcggagagaaagagcaaaggggaaagtgttacacacttttcaacaaccagatctcaggagaactcactcattgtcatgagaacagcatgagggaaatctgtctggaacaggtttgtgaacccattgaggtgttcatccagtgctgtttcagagaaatctctatttcaatctattcctatacattagttactgaaaaacaacagacaatcacaaaaacaagttgacctttttgtgatccttgagcccagttgcgaagggccctcgtgaccgggcctcatgccaaacaactcgttacaaaaagagctagggttccagactgggctgaagcttcatgagacttctcctcgtctgtgcgcagacagctggccaactctggagcccaggctgttgcttcccggtctgttggtgaatcctccatagtctggtgagtgtacatatatatgtatatacatatatatatatatatatatatatatatatatgtctttttccttcccattgcaatttgcttattatatcagtctgcttattatttcatttgcttattatatctgcattgccatttacgtgggataaaggttgtttacccttaaaggtgttgtgtgggtgtcttttcttctccctttacatgtcttccacacagaacatgtacacatgtatctacaggtgcatgtgtgtatgtagaagtgattgcacctgtgtttatgtatacatgtctgtgtacaccacatgcatgtgtaaatgtatgtgggtacacgtgcatgcatgtgtatgcatacatgcatgtacacatgcacaaaggtatctacacatacatgtgtatacatgcatgcatgcatgtttatgtatacatgcatgtacaccgtatgtatgtgtgtatgcatgtgtgtattttcagacgcatatgcatatgcatacatgcatgtacttgcatgtgcacacgtagctgcacattcacgtgtgtatgtatacatgtatgtacacgtgtgtgcatgtgtgagtgtgtaaagatatgtaaacatgtatgtgcaaatgcatgtgggtgtgtgtgcatggatgtaggtgtatccatgtattgtgtacacagtatgcatgcatgtatgtgtgtagatatatgtgcagatagacatgtgctcacacgtctgcatgtatgtgtgtacatgtgtatgtgtttacccacgtacgtgtgtatgcacgtgtgtacgcatgcatgtacatgcgtatgcatgtgtgtatgcatgcatgcacatgcgtatgcatgtgtgtatgcatgcatgcacacatgtatgcataaatgtatgcattgtgcacatgtatgcacatgtttgtatgaatgatgtatatatacatacacgtatacaccatgtataccagcctacaaatgcatctgtgcacacacatgtgaaggcgtgtgtatgcctgaatacaagtgtccatacatacgtgtgcatatccacacatacatgtgtacaacacgcatgtgtgcacacatgcatgtgcacacacaaaaattcgtgtgcaaacacatgcatgcatgacatatatgtgtacatggatatgtgggtatacatgcatgtgcatacacacgtgcacgtgcatgcacacatgcacacataatacatgtatatatacatacatgtttgcgtgaaaagcacgatgcatacatgcacacaaacataaatgtgcatacgcacgtacttgtgcatacaaatgcacatgtgtacccatacatgcattcagacgtttgtgcaatgtatacatacacctataagtacatacacacatatacactcatacatgtttgcacacacgcatacgtacacacatgcacgtgtacaaatacatgtgtgcgtgtgcatgcatttgtgcatattcattgattgtgtgcacaatatgtatgtgtgcatgtatgtgtgtatacgtgtatgtgtagatgcatacgtgtatgttaacatgcatgtacactcatgtaaacatgcatcaacacatttatacacgtatttatttgtgtatcaggtttgtatacacgtacctaaacatgcatgcgagcattcgtgcatgtatgtacacgagaatgcatatgtgtatgcatacgtgtatgtacacatataagcacaggcatctacacgtgtgcgtgcgcacctatgtgcacacttatgtatacatgtatgtgcacgtgcataaatgaattaagaaagaaacaattcacccaaacaaggaggaaaagatgaacatctcaagtacctatgagcatttttacatgcagaccccttactgacattggccaagacagatgacaagagatcatcaaggagagagttcattagaaaaagatactgctaacattagagaaacatagcatcaatcacccatagcatggatgctgttgagcttccacctgaaaaacaaacaacaacaacaacaaacctggcgggtagaaataggaacaggtttagcattacatccctccctccttttcctgggacctgcattgggccccataagcttggcatgaacctaagtgaataagacaccaaaggactgaagtttaccactaccttcagaattaggactcagagccaggaatttctttagactacataaccagtctatgcatatgtgaggatttggactgtagttcacactggctgcgcttccttatggaaacagtgactacaagatggaggatattaatgaaagatagcacacatctatactaaatgtcataacagcaaaaaccataagatagttactgacaatgagtcatgcaattccgagggaaaaactagtatgctacattcctccatgctacattctttcaaataagaatgaaagaatcaagaatgggccttgaagaatgaagatgaggagaaataatgggtgtgtggaccacgcaatggagtgggaattcctagataaggaaaggtatatggtctgtttaattaagggactctaaaatacttgttaaaaaaaacaaaaaaaacagcaagtagtgctttccagtaacaaagtctactgcaaatttctttctgtacatgggaaataaggactgtgggattctttgggtggatcccagcacctagagttggatctgatcaaaaagaagtgctcagtaaacatttacctactgctttggttgccttccccctgtggagtgctggcctccaggattgagcttgcatcataggtgttcagtaggaacttgcttagtggatttacaggttgaggttagaacccatcaggattcttttcctggaaagaacaggcatgtgttcttcccttccctctaagttttcacatagacactgggtgaggaaagagccctaaattgcttgaaaaattgattgctctttgagcaaagcaagaaaccctcctgtggaagggcatcatttgggcatatatcggggtctcagtacgaagatgagtgctcaagacgtcaagatgcttaagcagagaatctgaccagaatgttcgtggtacagagaaacagttttgttgggagaaggatgacaattgaggctttcgaatataagctaaataagcttcaaagggtatacaaaaaagaatcaggtacaaatcctttactacattcttttgtacaaatcaatttttgtctagaaaatcataccttactatgcatccctattgtgttcctccaccatctattttgtttttttaagcgttatttcattttcatgttcacagaagcttgttgctacaactacatgagcaaaacagccagtagcaacagaaatgcattaatatctctcctcagacctttaaagcattttccttaaaggtgaacaatattccgcatacaaggactttttcaggactatgtgccagaaattatactgaatgtttcttaattttcacgtaaatcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacatttatgtagtagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctgggggcatatagagccactcagagccttagaggtaccctcagcgaaatggaaccaatcaccatatagtgtagcctattgttcatctgaccaaaatgcactatgttgcgatagcatggattctacagacccgtgaagcccatttggaccacaagacactctttccatcatgcctgcacacatatccctcactcttcattgattcatgcagacttttaaaagtatttagcaataagcatcctacccccaagaagcttatgatctcatggagaagatggccaagcaacagacaatcccgacatggtgaatgccgctaaaacaaatgcttacctggatctccgtgagtgctaggaggaaagcaacccaaactcagaaaagtaggagaggtgtcagggaagacattttccagaagatggtttcgtgtctaacaaagccgtgagacgagcaaaggggaggtgaaaggctcagcgttctatgggacatttccttaattccagtatctctcgagttgagtgtgggaagctaaaagggaggaaatagaaatgaaaaatgggagttcttgagaggctttacttaccctgcacaagccaaggacaggtctgcgggaagtaagcagatgcagttaggaaagcccatatcaggagttagtcacgacagagaaagatttgtacactttggaaatcataaaaggatgaaaagcccaggtccttatttccgtgttttcgcctgtttttcacgttcctcccggatttcaatttctttctggaatctcacctctcctcatcatctgctcttgcaggaacactaaactggaaacgcaaccctacgattcagcgaactatgtcccatcaagattactgggtacaaatacatttactttcgtgttctcttgtgactgtctgtatcactgcacacgtttgttactgtgaaacaagcattaaaagtctgtgtagattactgagtacatatgcatttctttttttttcttttttttttattatactttaagttttagggtacatgtgcacattgtgcaggttggttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtaattctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatggtatctcatagtggttttgatttccatttctctgatggccagtgatgatgagcattttttcatgtgttttttggctgcataaatgtcttcttttgagaagtgtctgttcatgtccttcgcccactttttgatggggttgtttgtttttttattgtaaatttgtttgagttcattgtagattctggatattagccctttgtcagatgagtaggttgcgaaaattttctcccattttgtaggttgcctgttcactgtgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggttttcatggttttaggtctaacgtttaaatctttaatccatcttgaattgatttttgtataaggtgtaaggaagggatccagtttcagctttctccatatggctagccagttttcccagcaccatttattaaatttcttttcttgttctcccgtgacttttgatatcactgcacacaactgttactgtaagatgaacattaaaaagtcacgtctggccagtacggggatcgaacccgcgaccttagcgttattagcaccacgctctaaccaactgagctaaccggccccgcttactaaaaccccccctaaacctcttgagaagtttaaaggcgaacgttatttcaatcaccaaagaaacttttctgaacttctcggaactggaaagaacctgcgatctttgctaacttgtttatgatcctcggcaaatttctccgaaccctgacatttcaattaaaatacaattctgaggaaggaaagttcaaatgtcacctgcttcactgtttcatgacaaggggtttcagtgaccacccttttaaacgcaacgccatcaccttccgccggtactttggcctgcccttctcactcctttctactttgcttccgtagcttctgagcaacccgtgaagaaattgacggaaaacggaaggaattaccgccagtttctttccacgggccgtcaaggccaatataagtccccacccaggctcctctgctcgtaacttccagcacgattcccactgtattagcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacgtttcgaataattaaataaaagaagtctcaaccaacccccttgctgtattacagatggtccagctctctgcctagactattgtgctaatgtcctgttccttctcccggcttttgaactagattctcacctctctccaatccatctttcgcagggctggcctgtctttccgcctcacttctgaaattctatccattgccgcctctgtgcaaaccgactctggttaatacttcagtcggtatggctcccctcttccgcactttgcactgcgagaaatgcccttctttgaggcagctggaggcctcctcctcctgagagcttaattgtggacacagccttgagtagaggcgaaaaggaaagaaggctgggagacaatcggggaaaaacacacacctttggtctggtttgaaagctggcgcccgaaaaggaacaagaaaaaaaacacgcttcggaagtgtctgagattgctgcggccataaagcagagcactaaccctggtactgatacgggaggggagcaagactccacccccgggcctgtgcccatgaacctaggtgaggaggggcacttcttcctccgcgcccaaatgttgcatttcccaagaccaccctggcccgccacgcccccatcctgtgcctataaaaacccccgagaccctagcgggcacagacacaagcggttggacatgaagaggaacacaccggcgggagaacacagaacacccaccctctctttagtcaccctggaggcctcggagaaggcggtttcagtgatccgtgaagagaccctgagtcttttacatcccggagaatgacaagagagtacctgggcgacgtaactttctgggttttccggagatgcggttttctacacgccaggggccaagcctgagaaataggtggacggcaaggacaggagctctctccgcgccacaaacgcccctgctcacacctgggttccttgattttcctgcctatataaccgagccacccatggccgggctccgagctctcattctgcggactgggacaaaggggttaactgtgatgtgctttgtataaccccaggattctgcacttgcccaagggcgaggtgcaaatccaaaatcacgcacgactgaacgccgagatcagctgagtcctgagtgcctcacgacacaaaatccgtatgatttttaaaagcgctgtatttgtgctgacaatgcatgtcagatcccatctgtctttagctcaatgtgtgacgttagacacgtcgttttgctcctcaactttcttatttggaaaaaaaaaaacgagtgttctagatttgcagagggccttttcagagctaagttccagtagctatactgtaagttgaactcgggcagtcctgttggtgaggaaaaaggacaaattgagaaatgaacaaacacagaagttgcaaaagccctgtgacttacagcacaggacaagtctacaaaccctgccatgccacactaagctcaagttgttttaacatcagtttactcagacccgatgatccaaggtaagaccaaagccaaacggatccagcaactgggcagatcttcatgttccagcagctaagttccacggaataaacctatgattcgcctagtttagaaattgtctagtccctcctcagaaggaccttactaactttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcgtttttgtcatatgacattacttgtattttacaggattcacttggtctccatctgacctcctcagagtagactgctctttcccaatcactcctgcaattaccctaggagatatgtgatcctaaagtaacggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaacataaaggcaagtatctttttcactcagttcaccttggttctaagagtgggtctatataaagaaatggaacatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaagtaatcatgttataaacaatatgaacataaaagcaaaaattacatggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctagtgtatccacaaaaataagcattataagtaaatgcagctatgtcacagattacagtatacaaaaattaattgtatttctatgtactagcatcaaaaaaatggaaaattaaattaccactttcaataggtttaaaacaaatgaaatatttagagataaacttgtcagtgtgcacaggacttgtacctaggaatctacaaaagatggctgagaaaaactcaggaaagcttgactaattggtgttgtttgacatatttacagattgaaaaaggtaatattattaagatatcatttttttccctctgagttgatctatagatttactacaatcccaacaaatatcccagcaggagatttttgttttgtttgttttgttttcttttctttttgtttgtttgtttttacagaaattgacaagcttattctgtaggacctagagtaacctaaataattaggaaaagaaaaacaaagttagaggacttacaccaggtgatgtcaagacttattataaagctaaggtaatcaaaataatgtggtattgtctcaaggatacttacccagattgacggaatagaacagatagtccagaaacagaccaacgtatgtggtcaactgatttatgacagaggtaaaatgtttttttaaacaaatggtcccaggcaactgagtatggaaaaaatgattccctacccttacctcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaatataagatgcttatatggccaataggcacactaaaagatgttcaacaacattaatcagtacaaaaatgcaaattaaatctatcaaggattaataggtaacaacagatctcaactcccctgaatggagaaacaattagtaacacagatattagataaagataagttacttgaaggatcaatcagtgaaaagatacttgggcttatttccaggtttgtgttcttaaaaagtgatgcattcaacagagcatttgaggtaactgctaattagggacggtacttccttctctttcatgtaatgggagagtgaaatcagattagaactagtgctttcctaatgagatcttttctctctttctcaggatcaggactcagattgaaaaagcagaggatggtcactgccttccaggtctgaggctgtctcccagaagcttcactcctggcttcgccttggtagggaagtttccggaggtgttcgaaaacctggaaacttaagtgggacataagacgatatttgtgtcccggttataaaaattggcagaaaagacaagtgtagtgtgggggattagctcaagcggtagggtgcctgcttagcatgcaagaggtagcaggatcgacgcctgcattctccagcttcttttaatccctaggctaccaatggtatctggcctagatgacagttgcacagtactcgttattgttgtggcagtatctatgaggattattggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggctatgccgtgaagctctggggctgggagaagctgccccaccacttccgggcggcggtggcggcaaggagcaggtgacgatcacaactctagagcgtgctggaatagctgtgcccccaagccaggcagttccgggtggtgcttctccatccagaatgtgctctctgattccgagagatgaagaaggcgaaattgggaagtgaggagagaggtctccctcatgaccttctttggaaatccctattcttcgcactggcaggctcatagaactttgctgaaggcagtatctgagaagctcggccctcaatctggtcctgccaggggtttggcgacacaaagcaccggcatgctcctaataaccaggaaaatgggtggggtgaaaagtttctcctctggggaattagctcaggcggtggagcgctcgcttagctatgcgagaggtagcgagatcgacgcccgcattctccagtttcttgtctggtttatgtctcttagtttgtattccccgttgtttctcctgttgatgacatcggtgcctcttacctgggagaagatcagaggaaactgccgcctccctagagcccgtgttttattgatccccgtgtaagagtcttgttgcccctgcttccatccttccttcttttccactcctgccacaggtttggcacttctaggtactcaggtgtcagtgcaaatttcccgtctttagacaagtacagctaaaagtgatgcccacacgatctctcagttcctattacatcttcacaaatatcgtctcctccggaaagtatgtctttgaattattggtttgtttttctctcccctagaatgggagcttcctgagtaccgaaacactgtctatgtagactgtgtttaactcacttcatcaccatgtgtagagttaaggttctataaaatacggttactgccttgaacagatgaggtgagtagtataaggaaacggagatcaaacacaaagcaatacttaaaaaaattacctgccacatttctaaaatcttaacaatagcattcactaatgttttttggttttcctttgtgctttctccatagccccttattattattattatcattgacatttgactgacaattttccatttgttttcaaatgaccaagcagattttccaattttctagttaattcctgtgtttccttcaccattctattttctggttttcttttgggctaccgtcttcttcttcttcttcttcttcttcttcttcttcttcttcttcttcttcttcttcttcttcttcttcttcttcttcttcttcttcttcttcttcctcttcttcttatccttttccttcttctgcttctgcttcttcttttcttctttttcttacttcttatatttgatgcactgatttcttctaatgttttgtaacttgggtattaaaaggtgtaatttaaaatgagaaagcagtttctacagaatccttagaaatatgtcgttataagcccccattttcattatattctaaggagctcaaagatatacttttgattcttttctaaactgtgcattcgagagttaatctcttcttgtttacttttatgttcattctttcaatgttattttctaatttttgtgtatcattttatcaacatataaatatatatattcacataagtatacgagttatatatacatgtatttatgaatggcagctgaaacacacattagtgctaatattggtgactaaaagttggagaaccagacattatgtacctcataaagcgaagcaatggaaagtgcacaagcccacctatcaaattgtcttcttaaaagatttgaagctgaatctaagtgagcctctacttgtaactaccagtttacaagaaatagagtagatgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgtttaaaaaaaaaaaacccaggatgtataacacaaagagcaaactgtaatgtaaactgtggactttagttaacaataatgtattgataattactggtttaccagttgtaacaaatgcaccacgctgatgcaagatgttaataatagggaaaattgtaagagagggagagtgatggagtttatggaaattctatctattctgatcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaagttaatattagatcatatttatgatctattaccaatttgttaacaataggtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggatgtggtagtgcacgcctgtaatcccagctacccgggaggctgaggcaggagaatcgcttgaacctggaaggtggaggttacagtgaagcaagatcacaccactgcagtctcaaaaacaaaaagtgtttattgaaatttttaaacttacaagtgctgtgacatttaaataaatcattttctctacatacacggtttttgcacttatacatgtctagacaccctaggaatggtggtgccgtggtgtgaacatggagcctggaatggccagccccaaaacctcctcctcatcaactgttgactcatcaacagtcagtcagtaatcataacttccttaaaatacaagagccgcaaaactttccgggatatctgtgctacttaatctggcagttcctactgtgtcttgcccccggtgtgacgtgctctcttccatgaaattaataactgcaaactgtaatgggaacaaggcaattgtctccgcactcttacccaaagcgttctctgagatgtttggtagttatttgggtccttacttgaccttcgtggccttaaaacaaagggaacatggcatttgtgaatctgaaagacttgtgataattttctcatttcctccaggctgtgtgcctcactctgagtttgcggagggatcagccctttttcagggcgccctcatgtcctgagtatcatcctcagaatgtgaggcttgggcccaatctgaagagggtgtgagggagagccaaaatgcagggattgtcccacaatgcagtcccgctctgtaaatcccttcctctgactagcttgatttcaggctctgagaatggatggggtgggatcgtgaaagggtggcctgtccctccacacctgtgggcgtttctcgtcgggtgggacgagagactgagaaaagagacagagacaaagtatagagaaagaaaagtgggcccaggggaccggtgttcagcttacggaggacccgcgcagcccgggtctctgagttccctcagtatttattgatcattatctctaccatctcggagagggggatgtggcaggacaacagggtagtggtggggaaagggtcagcaggaaaacatgtgaacaaatgtctctgtatcatatacaaggttaagaaaaaagtgctgtgctttgatgtgcacatacataaacatctcagtgcattaaagagcagtattgcaggcagcatgtctcacctccagccgtaaggcggttttctcctatctcagtagatagaatatacaatcgggttttacaccaagacattccattgcccagggaggagcaggagacagatgccttcctcttatctcaactgcaaagaggacttcctcttttactaatcctcctcagcacagaccctttacggctgtccggctgggggacggtcaggtctttcccttcccaccaggccatatttcagaatagtacatggggagaaatcttggacaatacctggctttcctaggcagaggtccctgcggccttccacagtgttttgtgtccctgggtacttgagattagggagtggtgatgagttttaacaagcatgctgccttcaagcatttgtttaacaaacacatcctgcatatccctaaatccattaaaccttgagtcgacacagcacatgtttctgcgagcacagggttgggggtagggttacagattaacagcatctcaaggcaaaagaatttttcttagtacagaacaaaatggagtctctttgtctacttcttccgacatagacacagtaacagtctgatctctctttcttttccccacagattgcttttcagtactttctgctgagacatttttgtatattcatttctctctcaaggagcctctataacaaaagagaaaaaagtatctcggtttctgtgtgtggcacatgagtttgaaggatttctgagactgtcgttcaggactggcgttacagattaaacgccaataagattcaggaccagggacgatgggatccctgacaggcggatataactcctcgttaaggacagactgcccaccactctccttctttctctgtttctgaatttattttctataaattccgctgggtatcagaaccttccttcggctgactgacgctttgcgatttcctctccaagcccggatctgttccccaaaagtctctcgttcctgcttctagcttctctttttagcttctctaggttcgcgtcatcggctttccttttttccgaggttgaatccccagttacaagaagccgagaggtcttcttgtcataaaattaacttccctcggctcctgtaacagggagtgggagcccaccctcccactcgccgtgtagcactctgcatctctgagaagaaagtgaccaccccagcccagcacagcacagattttctttgagcacctgctcggagttcctgtccctcgtcgctccttggttttccctcatcgactacatacagtctgttggatgtcggtcaaggtatcgccagcccctgccatgggaaccatttggggaaaaatagatccgatttattatacttcaaagatgcccaatgattccctgtcgtctgtgtaccataaaaataaaaacagataaaaataagatcaatgtattcgacatctacacccaggcgtacagctctgaggtgatcaactgggaagcgaaggtagcccacccagagggaagaaaggaacaaagctggagaatgcagacgtggatcctgcaggccgctgcctcccaagtgagcgggttacaaattccgctaaccccagccccccaccacgctattggctatttgaggcatgtggggtttttttccggactagaagtcttgtgttccacctggattttcgggaccactcaacattcctgagctccacccctgccaaggtggagccagcacaggactgcaggcggagtctccagactcatccagaaacagccactgcgcggagccgggagcgcgtgtcgaaagcgcacccctagacagctactgtgggaaagctctgggccggacacaattccacatgcttgatattttagaaaagaaggaattataccctagctgtaaagggagtgtggattacagctataacaagtaccaggaaggtaagctttccttgcaaaagctgccctctctgaggctcgaactcaggaccttcagattatgagactgacgcgctgcccgctgcgctaagagggcgacgaagtataatgccgcgccagcttccacaggaatttcctaatttctttccccaggtgggctattttgggacttcagttttcttcgcccagggtcgctagttctccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctttcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaatactctattaaatactttattcccataatttcatttagtcctatttatttatttatttatttatttgccataaatctatacatcattatccccatcttactgatgaaactgaggctcagcagaactaaatccacagctgataaggggtaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacttgccatgtacccgacatttatgttctagatttccaaggcatccttggccctttatccctcacatccctacaaacaccttaaatcattagttctcgaagtgcggtgcccagacccaccacataattctcgaggacacattccatttcaggtactgtcctacccgaaggctttgaggattcagaagaaattgagccatccctgacctcaggagctgacaggacaaactgtcctatctggtccagttcctatactctcaaacttccggattcttataaatgcattttcctaaatattttattttgatactgtaactcttccgctctgtactagtttgctagggctgccataataaatatcacagactgagtggcttaaccaacagaaaattttctcagttctggatgctagaagagttgttagctttggtttctcctgaggcctctctccttggctcgcagatggtcacttaccttcttgctgtattcttgcatggtctctctctctctacacatatttccatcttttcttataagaacgcctattgggatttagggtttcgacatgaatttggtaacgggtggggcaggacaaaattccaccgtaacaggctcaaagttgtttaaatttccaccttcagatttgcagtagactttgttactggaaagcactacttccttttttttttttttttaacaagtattttagagtcccttaattgaacagaccatatacctttccttacctaggaattcccactccaatgcgcggtccacacacccattatttctcctcatcttcattcttcaaggcccattcttgattctttcattcttatttgaaagaatgtagcatggaggaatgtagcatactagtttttccctcggaattgcatgactcattgtcagtaactatcttatggtttttgctgttatgacatttagtatggatgtgtgctatctttcattaatatcctccatcttgtagtcactgtttccataaggaagcgcagccagtg

SEQ ID NO: 179 - DNA, 72518 bp, Homo sapiens
gaaccggccaaagtatgagacccatatattgagagtaacagagtgtaaagttcaaaaaaatcaaaatatttaaagatttatcatgggtcttgatgacatgatggaatctctctactctctggacttattatgtgtggtaataaatttactttttaaaagccagttgagtgtttttaatgttgtggagctattgctaagagtttcctgagttttttccagtaatgtagagatctttgtgctaaatatttcataaagaagtttggtgggttatgtgttctaaatcctaatcactggcattaactcaaaccagccatataaaaggtatgaaaaatgtctgtctggcgtgcacttggttcactgagcttttgctttcctgtcagcaaattagacattctcctcacttaggaggccaacttctcagccactggctccagcctagccctatggtctgtcagtggctttagatttaattgacacatgcccagccccaactctctcctgccttaaggatataagagccattgtgagccgcaaagttattatatccgagaacccagaaaaccacttttgtatatagcagtccgctgttttctcatttaaacatatgggttggaatagcataggatcatacacctgtgagcctacctgttttacaagttaaaactttttcctgattcttgcaagcattttttctcactcaaccctacatgcatgtgtgcagaattttaaggtaaaattagtttttgtagacactgaatgtgctgccctcaaggaatattacaatggagtagggaagacagttgagcaaacagctgtttacaattctgataaaagtcacaattgagatgaatactctgtacactaaaagtacagaaaggaacactactcttgagaatgagtagcctgataggatttgccagtgtttctgttatttcatttgttcataccggtccctgacacctggtttccttttcaagcaacaaaatcctaaaatctccatcatctgctgctttcacgttcctcaccactgaggtcaaggacccgaggctggcaggaaattgaactaatgacacttcaagaagaccatgaatcttttcatttttttcagctggaaagctgagagcagacaaatggcagggaggccaagtgctatcaaccacatttagaaattttatttaatctgcacatctttatttggtagaaagttttacaaataaaatttaacacaaaacaatttttttgaaaaaccatgttgacttaagcagagccaatgatgcaaagcataatgtatcagaagattcctgattcaactgctagcttgaagtcgccccctccttgtgttctggaaagatggggtgttgtttatcatccacatatcaaaaagtaaacagaaagcagtatttccgaaaccttttctttataaggagatcttcataaaacttgcattattacccttgttggatcataacacacctgagaaagattgggtggaggaaggtgaagaaggctggaaaagatttacaagggaataaatcaagaatctggtacaaattgactaatggtatcttctgcatcagcccatttcgagtgaaaagtcccccgttttagaacttttggctctttgttttaatgctccctcctgagaattaacaaaaattttgattactctgggcacgctacctgattagccctgctccgcaaggagcagttatatatatataatcacacactcacacacacacatttttcagggaatcctgcctaatttcttccgaagttcagctgtctcagttcacaccaaacaagttacacgatttcataacggatagaggacagaagcttaaggagggagggccgaatgcaccgggaaccctagtcaagtgtaggaaatcatcacgagcgaggcgaagcaggtcgtgggagacgagaccttcactcaggaacggggacgatgtgaatcgtgtttctatcgagtggctgggggaccgggttgggatcagccaggaggaggtagccgcacaaggcttagctgggtctcccgcgcagacatctcctggacagcgacccagcgccgcgcaggcgctcacggcccggctccagggctgcgggtggcgagtccctgcctgcccggagctcgccctcggggaaggacggacgcctcgcgacggccgcggacgcaccagcgcaagtggttccttggaatctccccatgtaattccacatgagattaaatttttaaagcgcctcatactcgtgacccatgggtcaatgccatctagcaaccattcagtggctgaatcctcagacaggcactcagcatccccagagcctaggggcatgccatatgcccccacataaagatttgttgaatgaatgaaggtgtctaactccattgtcttgccctattaaagatgtatactttctctgcctagaccattatggtaataccctgaccttcctcatgatctttgcactcaattctcaactctgtgccctattggaatggtactgaaatgcaaattcagttacagtctctcctaaattcatttaccagcaaactttgcttacagtgcttaaacattttatcctgacattcaaagcccttcctaaaaagctggcctctctcgcagctttactcctggaattcaatcctatgcacactctcagaaaacaaaatcattgttaattcaccttcaaaacctgttgttttattcttctgagactttgcaaatacctttgagcaaggcatcttgatagctcctcatttttaaatgtaactgtggataccaccttgagtggagatggaaagaaaagggaagctgaaggataatggattgtaaaaattcatgctttctcattcttgtctggtttgataatcagtgcctagaaaggagtcaaagaaggttttctttatatatgttctaaataacacaaaacctagctccgcattaaagccttagaattagtttctgggattaattaaaaaagcagtcgacttcagactgtcatattcagattcccacagatgttgcagccacaaggcagaatactaaccactataggatcatgacaggccactgggaaaagctgatgacttctacttattacaaatttgtcatgccaattgccttttcatcaaaccagtaagagctcaaaagggcatactttatgattacaaagtggaaataactttgcaaaatcttcatgggtagacgaatcttgcttattttcacctgtggctaattatcttgctcattccagaaaaccagaaaggctcacagcttgccatcttatcttggtttaagaattctttttgaacttaccctgtgaaagaaaacacacagaagaaagctttccctctgcatgtcactgatttctgaacaggaaaatacaagaaaagtattatcataactgtagacactgggtataaactgggggatctagattgtcagcttttcaagaagcttatattctaggggagagatagaaaataaaacaataatttaatatgttttccaatttattaaaaattttatttaaaagatggagagagagacaggacattgattcagctggagaggtcaaagaagggctctctgagacagtgacatttgagttgtggcctcagtgttgaaaatgagtccactcttctgggtctggagcaaaagtggcggagttcagaggctgacagctggggtctgggcctctgtgggcagccagaagatgagccaatagagtaccccacttaccagactgacggcagagccaaatatgaaaatgttcttttttctcaagcctcgagactgcacaccaaagtcccaagcaatcaaggaaactccatttccagttccttggtgtctctaaggcataggctcaaagtgaagcagacttttccctgaggtgaaatgcagagacagtcccactgctcagctcagtgtggatcatgaccttcctgcccttcccttctagctcaccctcaccagattctgaggactgatgaggaaggaattgctttacagcattttctgctgagcatttattgcatgattaggtcaatctccagctcactgtgcacttacagaaaaaaaatctaccaggtttcatgtgtgaccttgaaaaatgtcctcatttcttctgtttgtaatttagtaggttatccagaggaattttccctggatgttatcacattacacagtagacagagtactgcaaaggtgaggcccaaggcagatggaaataaccacagttaactgcctgctgccacatacaccgtattcctgatctgcctgtgagacttttttctaaggatttagtttatgccaaatgtttcattccctgactctggctttctctctgtctgtcatctccagtgtcagataccagcctttcttatttttgaggctaaatctccacataaatctcagtctcaattagcaaaaagctcttcccatcaccactaaaataaccttattttgggcccagagtatggggaatggatgtctgctccaaccctctgtaatgcagcctgcgttctcttggttttctttaccttttacagtcctttacttggagtgttagtgaaataattgccaagcccaacctgtacatgcccaatgaagaaagaaccaaaaaccccaacatccattactatctacatttgaacctctgaataagtggaatagttcttctatttatcagacattaattcagaatctcttttgtgtctgccacccaggttcaaaactcccaattgcccttgacttctcctccctcaaatctttatacttagggtttttatagatactgtagagccttcttatacaacctctccagaatattcttttctcatttgtctgttctttcatccattctacaacatttatttagagtgtattttgaattaggcgctgatgatgaagaaagactcatgctgttgacctcaggacctgacagaataaatgaggatgaacctggatccttaatttttttaataatttatttcgctttctctccaattccaacctctttaaacttcacaactaaaatcctcttcctaaaatgttgcttcgattacataagccacccgcctggagttaatcctctcctcaatatatctgcaaatgtctaggctttcccaacactatttccatcaatacgcattttacaaacatacacacacacacccaccaattaaataggtatgtcccacaatacacactgaaagatttctataccatcactgttctttctgtcctgtgtgccatcttcatcttcatttctcagctatatctatttttatttcttctctttaatatggccttgccccttgccacctttctgtaatacatttctggttttttgctattcacttatatggtatggttatgtgactacatatgaaatacataaacagggattgaaatttaagttgttataagtttaaaatagccggttataattatataattataaaatgttttaggtaaacctcacgataaccacgagacaaaaacctatagtaaatccacaaaagataaagagaaacaaataacagcatactaccacagaaaataattgaatcaccaatcaaaacagcaagagaggaagaaaggaacaaaaaaccctaaaaaacaaccagaaaatacttaacaaaatgtcaatactatgtccttaactgccaataattgccgtcatgtaaatggattaaattcttcaatacaaagatatagaatggctaactggattattaaaaatatatcccaaaaaagacccaactgtatgctgcctacaagaaattcacctcacctttaaggacacacagattgaaagtgaagagatgggaaaagacattctgtgcaaatggaaatgaaaagagagcagatatacttatatcagataaagtagacttaaagtcaaaaattgtgaaaagagagaaaggggtctttatattatgataaaaaggtcaattcatcaacaggatataacaattatcaatttatatgcacccaacattagagcacctaaatatagaaagcaaatattcatagatctaaagaaagagatagactgcaatagaataatatgaggggacttcagtcccccactttcaactatgaacagatcatccagagagaaaatcaatagaaaatattggacttgatatatacgttagactaaatggacctaacagacatatacagaatattccacccaacaacagtagaatgtcacttctatttaacatggtgctggaagtcctagccagaatacacattctggtcaggtgcacatgaaacactctccaggacaggccatagataaggccacaacatgagtcttaacaaatttgagaagactgaaatcatatcaagtatcctttctggccacaatggcatgaaacaagaaatcaacaacaggaggaatttttgaaaattcacaactatgtggaaattaaacaacatgctcctgaacaaccaatgggtcaaagaagaaatcataagggaaattgaaaaattactttgggacaaatgaaaatggaaatacaatataccaaaacttacaggatacaagagcagttctaagagagttttcatcaaaaaagatgaaagatcacaaatagactacctagcatccattacacctcaaggactggaaaaacaatcaactaagctagttacaaagttagtaggaagacggaaatgataaagatcagaagaagtaaacagaagatagaaaaaataaagagaccaaccaaactaagaattttttttaaaggtaaataaaatttacaaacctttagctagactgattaagaaaaaaaatgcaaagactcaaataaaatcagaaatgtaatcagaaatgaattgaagaggtaacgactgttaccacagaaatacaaaggattatttaaaaactactatgaacaattatatgccaacaaattggataacctaaaaactggataaattcctagacacatgcaacttgcaagacagaatcagaaactctgaacagagcaaaaacaagtaaggagattaaatcagtgataaatctaccatcagagaaaagcctaggacctgacaacttcactgctgaatttgatgaaacatttaaagaggaaataccagttcttctcgatctctttcaaaaaactgaagtagaggaaatactcccaaacacatttcacaaggccagcattaccgtgaacccattgcctgaggagagcactacaaagaaaaaaaaattacaaaccaatatccctgatgaacatgtatgcaaatatactcaacaaaatactagcgaattgaattcaacagcacatttaaacaattatttaccatgatcaagcaggatttatcacagggatacaaagatggttcaacttatacaaatctgtaaatgtgtgatccaccgtattaacagaatgaaagacaaaaaccatctcatcatctcaatagatgcagagaaagcatttgacaaaatttaacattccttcatgattaaaaactctcaaaaattaggtatagaaggaatgtaccttaacacaatagaggcctttataggacaaacccacatctaacatcatactcagtggggaaaaaaattgaaagctttccttttaagatcaggaataagacaaggatatccactcttgccacttctatttaacatagtactggaagtcctagccagagcaattaggcaagagaaagaaataaaagacatccaaattagaaaggaagaagttaaattgtccctgtttgtagatgacataatcctatatatagaaaaccctaaaaaactcaccaaaaatcaaaactgttagaaataaaaaacaatttcagtacagttgcagaatacaaaacaacatacaaaaatcaacatacaaaagctagcatttctatacactaatggcaacctaaccaaaataaaaaattttaaagatcccatttacagtagctacaaaaaatacttagaaataaatttaaccaaggaggtgaaaggtctgtatactgaaaactattaaacactgatgaaagaaattgaggaagacacaaatggaaagatatcctgtgtttatagattggaagaattaatattattaaaacatccatacccccccaaagtgatctacagattcagcgcaatctctatcaaaatcccaatgacatttttcacagaaatagaaaaaaaaaacccttaaaattcatatggaagcacaaaaggccccaaatagccaaagcaatcttgagcaaaaacaaaactggaggcatcatactacctgactttaaaaatatactacaaatatatagcaatcaaaacagcatagtactggtggaaaaacagacatataaaccagtggaacagaatagagagggcagaaataaatccacacatttatagtcaattaatttttgacagacgtgcctagacacataatgaggaaaggatagtctcttcaataaatggtgttgggacaactggatatctacatgcagaaaaatgataggaggcccttatctcataccacatacaaaaatcaactaaaaattgattgaagacaaacataagatgtgagactctaaaacttctagaagaaaacatatggggaatgctccataacattggtctgtgcaatgattttttggatatgaacccccccaaaagcaaaaagacaaaaatagataaataagattacatgaaactaaagaacttctgcacagccccccccaaaaaaaatcaacagtgaagagacaaccgatagattgggagaaaatatttgcaaaccatacttctgtaagtggttgatataaaaaatacatcaggaactcaactcaatagcaagaaaacaaataacccaattaaaacatggagaaaggaccttaatagacatttctcaaaggaagacacattgccaacaggcatatgaaaacttgcttaatgtcatttatcatcaggcacatgcaaatcaaaaccacacctgttaaaatggctgctatcaaaaaggcaaaagataacaggtgttggcaagaatgtggagaaaagagaatccttgtacgttgttggtaggaatgtaaattagtgcagctgttttgtacagcagttcctcaaaaaactaaaaagagcactatcatatgatccagcaatcccacttctgggtatatgttcaaaaatcgggctattgaagagatacctgcactctcatgttcattgcagaattactactaaagtagctgaatcaacctaagcgtctatcagcagatgaatggataaagaaaatattacaactgcacaatgaaatactattcagtcttttaaaaaacagaaatcctgtcattttcgatgtcgatgaacctggagggcattgtgttaagtgaaataagccaggcgcagaaagacaaatactgcacgatctcacttaaatgtgaactctaataaacgtcaaactcatcaaagcagagagtagaatggtagttaccaggggctaggggaggagatgggaggtaggaatggaattagagagatgtttgtcaaaggacacaaaatttcagttaaacaggaggaataaggtcagatctactgtgccgtatggtgactacagttaataataagtgtattctgtactttatagttgctaaaagagtagacttaagtgttcccatcacacacacacactaagtaatagatacgttaattagctcgagttaaccattccacaatgtatgcatatatgaaaacatcatgttgtacatcataaatatatacattttgtacttgtcaactaaaaaaattgtaaaaaccagtatttaatgctcatctcaaaatataaaaagcctgtgatgcaaagggtttctatggtgtagtcgttaccacgctggcctaacacatggaaggtcctctatttgaaactcaacggaaacaacaggtttctctggtctcccagaatctgaccgggagtggccgcttcttcccgggagtccagagctgcaaggaacaagtgataatcccgcctcttttaaaagaaagatcgtcatcctgggatagctgtgccaaattagcaggccgctctgggcgggcgctccccagctgggacgtgctcgcttctctccctgaaaatctggaacgtgaaatcttacagcaccagacttttccagtgtccactttctcctggttacgttttcccctctccctcgcagaggaatagccatcatgcccttgcccttggccatttttgagtagactcgccttaggtcgagtcctggttccccactaataatcgagacatttcctttgttccgagacgcaagaaatggtgggtagtcgcgcacatctactcctgaataaaggaaagggcagaaagttttgcggtaggtgacgagtgagcgcaagtggtagagtactcgcttagcatgtgagaggtagtgggatcgatgttgtcacttggggccgcatgtccatacagtacaacgtggagaacggcttcattagtcacctgtcgaagaaaacgaggaagtaccagccatcttgaatgcttcactggtaaaagacctatgggcataaagaaacagtgctaataatagcccctaaaacgttcagtggacagtacccattttctaagttgttttctctttattcagaggaaagaggagatcccaagagggtgggatatacccaattgttccttttctctccttcctgcagcttgacccaaaatgccaaaatgcagcacagctctggaaaatgcagggcagagcaggatgagtaaaaccccagctttctttctggtcagggcgctgtaaagtggagttccgagtcaccgggaagtcctgctgagagtgtggaaagcaaacccacaagtggtttgtcaactcaccgagtgcacccctgagttgcgaatatgtagctgtaaagagcaaaaccaaatacagaaagcttattttttcccaatttaaaaacatgttttgtgattctactttagacatcttgaataggcaaattcatgtagacagaaagaatagaggttgttggggagagggaaatgtggagttattgtttaatgggtacagagttgctgtttgggatgctgagaaacttctggaaatgggtagtggtgatagttgctcacattgtaaatgtacgtaatgccactaaattgaacacttagaattttaaatgtaaaatgggttaagtatattttaccacaataagaaaacacaaactcttgttcattctgtaatttagcacatagtctcatcatctgtttttctccacaccagctcatctgttcatccttctattcatttgacaaatacttagaaatgtctagatttattgttccattcatcagacattaattcaggatctcttgtgtgccacagtgtcaagacttctccctcaaatgtttacaccaatgtcttgacaaataccatagatctttcctgcacagcctctccagaatgtttttcttacctttcactcatgtttctcttgcccattctaccacgtttatggaggacgtagtctgcaccacaaagtataatgggcactggagctacggaaagactcatgctgttcacttcagaagctgacggaataaatgtgaataaacctcaattctttaatctatttataacttctttccatttctcttcaattacagtcttcctgttcccaagctctttgacatccaacactaaacacctttttcttaaatgttaatttggttatgtaagctgtctgcaattttttcaagggttcttaagtctcaatgttttcccaatcattatctccatgtgcacaggcatttcaatcactacttcctttcattttataaacaggcacacacacaagcaggcacatatgcacttgtgcactacacatcccaagtgaacaggcatgtttcctcacacaggaattcctacatctatgcctgttccttcaaactcatgtgcattcttcctcatctgcatccttcaaggttcatatttatccctttactacaaactgatcttttaatccccatggttcttgtctgtaatacttttgtgatttttgctgttttcttatgtgatgtgaatatgtgagttctatatgatgtaacttaaaaagacttgaatataagtatgtgtatatatatatatatataaatctaacataaatatatcctatatatcttagaaatctaagatatatacataccttgaatatcttagatatatctatcttagatttaggaagtctgagggtttcctcagtgtagtgtagaggttatctcactcacttgcctaacacgagatgaggccctcagatagaaagacagatgttatataattataaagcgtctattcaccgaagggacacaactgtcctaaatatgtctgtttctggccacagagcttcaaaacttatgaacaaaatggataaaccagaaagaaaatagaaaaatccaattacagttgcagacgttaacactcctctctcagtaattgatagattcaggagaaaacaaatcagcaaacattttagagaacagaacaacaccatccaccaatggatctaatagactttataaagcaaaatcacaatttatgtagaaaggcgagccaaaaaaatcaaagaaaagcaagatcatattataagtaggaaatcacgaatggtcagagtgcagaaaagtgacattattgaaactgatatttctgaaacagttacttaaatagcaggaagaccgataacggcgaatctgtaagtgaatctttccttgtccatatgtatcctgctttttcttgaggtctgggctggccaaatgtctcctgaaattcctgggcctactacagtgtctggcacagagcatctctccagcaaatatgtactgaatgagtagaaaggaactgacggattcagaagagacctgcaagaataatgttcagtatttggcaaatcactgaatgtggtgtttgaaggaggacaatgagtcaaagttgacttggaaatctaggcccaggaggaggttgagaattagatatgtggtatatgaatgaatggactactgtggagaaaaacaggcagagagataatgagcaggagcagagaaaagactcaccttttggaatctaaaataaatgtgcttgtcagttcaggctttgccacctagcatctctggcaccttagaaacaataattatctgagcctccagtacatctagaaagtgcacattaggatacatcgttttgttagcgaaattcaactggactacgtaaacgcaagaaatctcgtagtatacttaatagcacacaagaaaaaacaaaggggtaaaaaacaaagagggtgccattataagtattttgtgtttttttttgtagcggcaatgtcttcagtcatgtagatgcaagtggagatatgaaggaagacagtagtatgatcaagagacaggtttgatggctatttcttcattcatttatccaggtggtcagtgaactatcatgaactgagaacctcctgtctcttttcaacagaggagactatggaaagtgtaagagtgactaaggtttctgagggaaggaaaagggaaaaagagcagcaaaagacaggtacaattgatcctggtaacgcagaacccagacggtcctatgaaatactggaaaggcgtagactcctctggtcgtgggtatggaatcttcctagtgcagcgttgattgatacagagtaattttcaagtaggattgattgtagtttttgaaagctgaaaccgtaacgtaggtgggaaatacacttcgacaaaatggatgttgcccgagctcaacagcaagccctcttagcgcagctggcagcgcgtcagtctcataatctgaaggtcctgagttcaagcctcagagagggcatcacttctgccaaagaagttggatacactaaatatcggaacgcaacgcaaatgctatagcagataaggatttgaagactgacccaatatttgtagaaaatggaaatataatttaggttttcttgttttttcgactttccagtggtttgagtaaaatgagtggtgaaaacagaagagtagattacaccagaaactacaagctatgtcatataattggtctttctagctgacacaggaagcaggggaaatttctcttccaacttcccgctctcagggtcacctcacactaattattgggtggatgggtgaagtcatttattcttttaatcatccaacaaatatttcttgaacacatatcttgttaagagactggggtcaagagtgaatacaacgcaaacattcctaccactgtgaaactacatcctacttgggaggagtggggtgaaagtgtattcagcacaaatattcctactattgcgaaactacatcatacttgggaggagtggggagaaacagacaggaaacaatcaaaaatatgtaagaagtgatttgacgatgtctactgtgagggaatcgctaggcagtaaagggtttgggaatgtggaggtggcacattcagctttcaggaggacaatcagggactctgtcaccttgacaactttagccttgccttcttctagccatcttgctggaacacttgtgcccgtgtttttctaacactgtcataagagtacttttacctatcaaggcaactgggggttaggagagctttttgcccagaaggctagttggcttccttggaaaactgatgatacatgaggactggggttgtcaatccctcacatgtttcttcatatgaaaaatgaggactgtgggattctctggctggatctcagcacctagagatggatctgggcaataggaactgctcagtattagctaccgctttggttgccttctccttgtggaaagctggcctctcacactgaatttgtatcataggcactcatgagggtcttgactacatcaatatctgatgggagactttagggcagttctgttgtcgtagctgatttgctcatttggtagctagcatccagcttcttgtgaacattaaaataaaataaaataaaataataaaataaaataaaataaaatagattatggaggaatagaatacagatacatactaaggcataattttccagacaaaatggatttggataaaagaatctaattaagaatttgtgcatggttcttttaaaattcctttgatttttttttttttttttggcctgtttttcaagtgtccaatttttgtcacccttctcccatcaggtcagagagatagccaatggtcagaagcaatcttccagcaactgccatagcgctttctcctgcctgcagatgcctctttttagtcagcctttatgggaagtagcagcaccatccgttcccagagagcaagctctggagtagctgagctaaccccagttgctaatctgagctaatcccagttaccccagtggatttacagattgagggtagaacccagcagggttctcttcttggaaagaataggcttccctctaaggtttcacatagatactgggtgaggaaacagccctaaatggcttcagaaattgaatgttctttgggcaaagcaggaagccctgctgtggaagagcatcatttgagcataaatcaggttatcaggacaaacagagtgttcaggaggtctagatggttaagcagagagcctcatcagaatatccgtggtgaagagaaacaatcttgctgggagaaggataaccgtaactggggacttagaataaaggctaaaaatgattcaaagagaatgcaaaaagaatcaggcacaaatctttactatattctgttgtgcaaatctcaccttactatgtgtttatattctattcctccacaatctttattttatttttatgttcacagagacttgctggttccaactaaatgagcacaacagccagtgacaacagaactgcacttaaatagtccctcatcagctcttgagagcagattccttaaaggtgaacaatattccacatacaaggacttttcagcagtatgcattagaaatggaactgaatgtttattattctttatataagttggttgatacgacttttcagcttccctcagtaacattatctaaattttgtagatgacagtaaagctcagaggagttaaaccattttcctcaaatcacgtagctttaaacaggaaaaccagatatgaaaagcagatttctttctaaattaaaaaacaaaaacaaaaaaacttgagctcttgctttaccctagcacatagtctcgccatctgttttctccacaccaggtcattcatgtaacattcattcacataacaaatacaaataaatgagcggattcattcatcagatattaattcagaatctcttttgtgtctaccacactaggctcaagacgtcccagtgtctttgtctcctctccctcaaatctctccacccaatatcttgacaaataaagtagatccttcctgtacaacgtctccagaatcttttcttccttttctttcacctctgtcatcattcatgctacagtgtttacggaggatgtgttctgcagcatgaagtgtcgtgggcactagctctgcagaaagacttctgctgtccacctcaggtgctgacatgataaatgtgggtaaacctcaatcctttaatatctttatgacttctttccctttctccccagttcctgttttctcatgttcaagctctgacattcaaaactaaacacctttctctaacatgttgctttaattatttaagcattctgcctgggatattttcagttagtcatgggatttttcataaaactctcccaatatatctccaagtggccaggcttttcaatcactgcttccctccatgtgtatttcacacacacacacacacacacacacacacactctccacttaaattgaacaggtttatttctttacacaagaattcttacaaacagcccggttttctccaccatatgtccactccttctctgcatagctcaattttgattcttacactatattttacatattcttacactctgatacgatcttgtctcttattctttatggctctgctctgtaattttgttgttgttgttctgaaatatagttggacatgtaacttgtacatgacacaccttagcaaggaggcaactcatatctcagatgtaagtgaaagaagcactctccaggggtttcctatgggagtggtcagcacgctggcctcattggtggaatggcctagttacgaaaacagcaggagctttttgccttccagaaatctggaccatctcacaacccccagacagtctcagctacaaggaaaagtgataattccatcccacttttataaacacacacaaacacacacacacacacacacacacacacacacacacaatcatttaatcatttttaatcatttaatcatttttttaaaatctctgacactttagctgggcaggtctagacatgtcctcctttgctgggatgtgcctttttctgtcccggaataccctaaacttgacattttggcagcacgagttttccctttgtgactttctccttgttccctttctcctccttctttgcagagaatgagtagccactgcgccttgccctgggccatcagtgagaagacctgctcttagtagagccctgctttcccgctgaaggccttgaaatcccctgtgttccaggacacccactaaagatcaagaaagctcccctgacgtggggaattagctcaagcggtagagcgcttgcttagcatgcaagaggtagtgggatcgatgcccacattctccaagctttattatttggaccttgggtctccaaacactcaagtatccaaacccaagttagtgtctgagagcaggatgctgctttggttcaagacataggagcagcaacaatacaggcctggtgatggctccctcctggcattcagtatagtgtagatctactgtgtaattcatttgctgtttcctcaaggagctgtgaaaccaagggacatatacaactgctcttttctccctgtttctgcctgcagcttggtcctaaacctcagacaatcgtgaaatgtgcagggcagagccacctgggtaaacacagcctcggctttctgctcaggggactgaaaccaggatgtgtcaagtaactagaatgtgcctggacagatactgtagaaagcaaacccataaagttgttcatgagcttgtggacacacctgccagctgtgaataagtggctctaatcccaaacaacttacctacaaagagcctgagagctgaactgcgcaatggcccactttccagtcctcactgaagttgcacacactccggaaatctctgaacagtggcgtaaaggctttgcaaatagagttatctttgaaacaacaacacgtggaaggctggttggtacttggaacttgaatacaaggcaattttgtgcctgcaaaaacaaaaatagcaatattattcttaagatttcaacaaaacacagtgtctcatcacataatccaaagaagtccaggttacaagccccaaaatcttcggcattatgaaaaaaacagggagatcttcattcacatggcaaagagactcctcgaataacaatactgagaggacacagatgtcaaaatcatctgacgcatacagtggagcagttatgataacaatgctcctagaattaggggataacattcgtgaagtgaatggaaagttggaaagtctcagcaaatatctggaatatataaacaccaattttaagcttaagaatttaaaaaaatgtattaaccaaaactcttaggggaaataaaaagcttaactggatgatctcgataacagaatgcagatgactaagaaaaagtcaacgaacttgaaaacagaacaagaatacctacataatctgagctatagagagaaaggagtatttctgtaaatgaacagaggctcagggacaaattaaaaaatagcaaatctaacattcacattattgtaatctgaaaagaagaggacaaagaggtctttgtgggataaaactttgaagaattaatggctgaaaatgtatcaaatttgtcaaaagatataaaccaggtttttaaagttcagcaaaggtcaagcaggataaacccaaagaaacccaacccatttcaagacgtatcataatcaaactgctgaaaacgaggaaagtacaaaacaatcttgaaagcagtcaaaggaaaatgaaaaagaaactaccatatgaatgagtgtagatttctcatcaggaaccatagcggccagaaaaaaatgtcataatgttcagtaagtaacaaaagaaaaagacctatcaacccagaatgctatgtggagcaaaagtatctttcagacataaaggcaaataaatgcattctcattggaaggtaagtcaatacattctcattcttagcaagaatgctggaaaagaattagcaaagatttgagataagaaaagtgataccagaaggaaacttagaacatcgtcaatgaaggaacgaaagcagaaatagaaaatgtctgggtagacataacagactgttcttcttctcctgagttccttaaggtatgtttgatgattgaaagccaaaattgtaactttatcagaagcagttgtcattgtatcgagatgtactacatagataagataaaagggtaagtgtaatgggcctaactcttgatgaagtttctatattcaacttgaatggtaaaatattgattctaagtatactgtgaaaagttatatacgtatatggtaatccctagaccacttactaaccagattgaaataaaccaaaacaagatagacagaggaacatagaagaattaaaacaaagggaacaaaggttaatacattattaaatagatctatctaaaaacttatctatattaacattacacgtaaatgatctaaatccttaattaaaaactagagatcatcagaatgtattaaaagtaaatatgctgactgtaagaaagccacctgcaatacacttatatatcagaataaaagttatatagcagattgaaggaaaagagtgggaaagatacctcatgcaagcattaatcaaagacagctgtggtgtatacattaaaatcagacaaagtagatttgaaagcagagaaacttttcaggaataatgaaggctgctagataattacgaatgtccattctccagggaatactgttccaaatgtatatgaggacacagattttcaaaactcataaacaaaattagataagccaggtaaaaatagaaatatccaattttagttgaagacactaaaactcctctctcagtcattggtagacttagtagacaacaaatcagccaacatattggagaactgaaccacaccatccaccaatggatctgatcaacttcataacgcaaaataaaaatttagccagaaagcaaagacaaaaattaaaagaaaagtaagatcatgttataaccaggaaattaagagtggtccatcatatagaagggtgctattattgaaagagtttgaaatagtgacttagttattttgaaagagttttgaaggcattatttagctggaaatgacagaaagactgaaaatggtgaatctggaggtggatcttccctcatctatatttatcttgttttcttttgaggtctagggtgtctatacttcctctgaattacctgatcctactacagtgtctggcacagagcatctccccagtgaatatgtactaaatgagtggaaagtaattgatagattcaaaagagttgtgcaagaataatgttcattatttggcaaatcattgaatgtggtgtttgatggaagacaatgaatcaaagttgacttgaaaggtaagcccaaggccagacgtggtggctcatttctgtaatcccagcactttgggaggccgaggtgggcagatcccttgacgccaggagtttgagaccagcctgggcaacccagtgaaatcctgtctctacaaaaaaaaacaaaaattagccgggtgtggtggtatgcatctgtagttccagctactcaggaggctgaggtgggagcatcactggaacccgggaggcggaggttgcagtgaacagagatcacaccagtgccctggcagtaaagtgacaccttgtcttaaaatgaaatgaaatgaaatgaaataaaataaaataaaataaataaaataaaataaaataaaataaaataaaatataaaagttaagcccaggccgggcgcagtggctcgcacctgtaatcccagcactttgggagaccaaggcaggcagatcacctgaggtcaggagtttgagaccagcctggccaacatggtggaaccccgtctctactaaaaattcaaaaactagcggggcacctgtagtcctagctactcgggaggctgaggcagaagaatcacttgaacccaggaggcagaggttgcagtgagccaagattgtgccactacactgcagcctgggcaacagagtgagactccaactcaaaaaaatttttaaaaaaaatttttaaaaagttaagcccaaaaggtaagtaaagaggaggtctggaattagatatttggtgtatgagtgaatgagctaaagtgcaaaagaatgggcagaataaccgtgagctggagcagagggaaaaaaatcacatgcaaaatctaaaaatatctgcttctcaattcgggctttcccacttagcagctttggcatttaaaaaaaaaaaaaaaaaaaaaaaaacacttgaccgggcacggtggctcacgcctgtaatcccagcactttgggaggccgaggcgggcggatcaggaggtcaagagatagagaccattctggctaacacggtgaaaccctgtctctactgaaaaaatacaaaaaaattagccgggcatggtggcgggtgcctgtagtcccagctactcgggaggctgaggcaggagaatggcctgaacctgggaggcggagcttgcagtgagcccagatcgggccactgcactccagcctgggagacagagcgagactccgtctcacagaacaaacaaacaacaaacaacaacaacaaaaacgcacttagcctatctgattctctattacttctaaaaagtgcatactaaggcataattttgttggcaaaagtcaatcagactacatcaagtaaactccctaagtctcctagtataattcacggcacaaaaatatgaggaaaaacagggaggatatgattaaaagtttagtttgtattttttgttgagtgaatgtctccagtcatagagatgcaagtgtagatacacagtaagagtagtatgaatggcagacaccttggaaggctatttcttccttcattcattcagttggtcactcaatgaactatcatgaattgagcactacctctgtttcttatcaacaaaggagactacggaaaggaagaatgactaagatctctgaagaagggaaaagctagatgactgggccacaagaggaaaaaaagcagcaagacaggtacaattgtgtctagtccctcaagccagaaggtcctatcattatgtgaatactggaaacgggtggactccacctgtcctgagtggggaattcttccagtgcagcattgactgataaggagtgatttccaagtagcattgattgtgttctttaaaagctaggaattgataaagcagcagtgcgtgggaaatgagatttaataatctggatgtcacctcttaggaacagttgctctcttagagcagcaggccacctgtcaatctcgtattctgaaggtcctgagtttgaacatgagacaaggcacagcttatgccgctatttccattaagagaaatgaaataggtgtgataaataatggaacacaaatgctatgagataatgatttcaagacagaccaaatattagcttaaaatttaaaagtgagttttcttttcttttctttctttctttttctctttctttctttctttctttctttctttctttctttctttctttctttctttcttccttgcttccttccttccttctttccttccttccttccttccttctttcctttcctttctctgtctgtctttatttattttttccttcttttggcttctcagtcgcttgagtacaaggcgtggtgaaggcatataaattacaccagaaactgcaagctatgtcttatgtctacctctctagctgacaggggaggcaggggaaatttctcttccaattgcctgctctgaaggtcatccaaacataattatggggtggggtgggtaaagtcttttattcttttaatcgtccaaccgatagttctcaacacatatcttgttaagagactgttttgggtatagcaattcgcagtgaataaaatacagatattctcacctttgtgatactacgtcaatgttggggggagtggggagaaagagacagaagcaaaaaagaaaaataaacaagaagtcatgtgatattatctactgggagggagtcattaggcagtaaaggactcggcagtgtggaggtgacacattcacttttcaggagaagaatcagggaagttgtcaccttgaagatatcatttagcttccctttcttccaatagtctttctttacatgggaaatgaggactctaggattctccggctggatctcagcacctagagatggatctgggcaataggaactgctcagtaagcattacctactgctttggttgccttctccctggcctcttggattgagcttgcatcatacgtgttcagtaggaacttgcttagtggatttacaggttgaggttagaactcaccgggattctcttcctggagagaacaggcttccctctaaggtttcatatagaccccgggtgaggaaagagccctaaatggcttgaaaaattgaatgctctttgggcaaagcaagaagcgccactatggaagggcatcatttgggcctatatcagggtctcagtacaaagatgagtgctcacgtggtcaagatggttaagcagagaatctgaccagaatgttcacggtgcaaagaaataatcttgttgggagaaggatcacaacaattggggaattagaatacaggctaaatgagactcaaaaataatacaacaagaatcaggcacaaatcctttactactacattcttttgtacaaatccattttgcctagaaaatcataccttactatgcatccctattgtgtttctccaccatctattttactttttaaactttatttcatttttatcatcacagaagcttattgctacaaaacaaatgagcaaatcagccaatggcaacaaaactgcactgatctctctccttagaccttcagaacattttccttaaaggtgaacaatactccacgttcaagaatttttcagctctatgtgctagaaactatactgactgtttattaatttttatgtaagttggtcgatatagtttttcagcttccccaagtattattaccctagtgttacagatgacactgaagctcagagcagttaaaccattttccttagatcacataactttaaagagggaaaccagatatgagaagcagatttctttctcaatgaaaaaaatcacaagctcttcttgctttagtctagcacatagtcttatcatctattttcttcacaccagctcactcatgtaacattcattcatttaccaaatacagataaatgagtggatttattcttgcatcgatcagatatgaattcaaaatctcttctgtgtctgccacaccgggctcaagacttgccagtgcctttgtctcctctccctcaaatctctccacccaatgtcttgacaaatactgtagatccttcctgcataaactctgcagaatctttttcttctgttttactcacctccttctttatccatgctatgatgttcatggaggatgttttcttcaccatgaagtgtgaaggggattgaagctgcagaaagactcatgctgttcacctcaggaactgacacagtcaatgtggataaatctcaatcctttaatatctttatgacttctttctctttctccccagatccagtttttccattttcaagttctttgacatttaaaactaaaaacctttccctaaaatgctgcttttctacctggaattttttcaatgagtctttagcttttataatattctcccaacatatctccaagcatccaggcttttcaatcactacttccctccgtgtatattttacacacacacacacacacacacacacacacacactccacttaaattgaacaggcatatttctttacacaggaattcctacaaacattccaccctatacctaccctaggttttctccaccctatgtccactctttctctgcattgctgaatgtgttttctttattctttcactctgatatgatctttgtctcttattctttatgcctcttatctgcatttttttgttattattgttctgccatgcagttggatatgtaacttttacatgacacaccttagcaagaagacaacacatgtctcagatgtaagtaagaaaaacactctccagggatttcctggtgtagtgctcagcaccctggcctcattcctgaaagtccctcggtgtggaaaaagcaggagctctttgccttccagaaatctgcatcatcccacagcctcagctacaagaaacaagtgacaatgccatctcttttcttttaaaaaaatcatttaagcttcctgagatatctgtgacacattagctgggcagggtccttctgtgggacatgtcattttccgtctcggaatatgtgaaacttgacattttggcaacaccagagttttccctttgtgactttctccttgttcccttttctcctccctcctcacagagaataagtacccactgcactcttgccctgggccatcaatgagaagatctgctcttagtggagccctgctttcgcggtgaaggccttgaagtcgcgtgtgttctagactgcccactaaggatgaaaaaagatgctgtgagatgaagaagtagctcaagtggtggagtgctcgcttagcatgtgagaggtagtgggattgatgcccacattctccaggtttcactagtcggacctcaggtctccaggttacagtggaaaaaaatatgtgttagacactgatctcagaaaacagtaagttagacactcatctcagtagcagcctggacacttctttggctcattatgtaagggcagcaacaatacgggcttgactaagattctactggtatgtggtatagtatagatctatcgatgtgtaattagttttctgtttctttgaggagctgtgatacaaagggacatatccagttgcacttattctccctgtttcctcctgcagcttggtcctaaatgcagcataattatggaaagcgcagggcagagccactcaggtaaatacagccccagctttctgatcgggagaccgaaactaggagttgccaagtaaccaggaaagacactgtggagagcaaacctgtcaagttgtatgtgaactcctggatgcgcctgtgagctgtgaataagtggctctgatcaaagacaacttatctaaaaagagcctgagaatcgaactaagtgatagcctactttccagtcctcactggccactgggttgcacatactccagagtctctgaatagcagtgttaaggctttgaaaatagaatcgactttgaaactacaacacacaaggctggctggttattggaacttgaacacaaggcaatcacatgcctgcaaaaacaaaaatagcaatattatccttaagatttcaacaagacacagtgtctcatcacataatgcaaagtacaaccccaaaatattcagcatatgaagaaccagggcaatcttaattcacttggcaaagagaatcctcgaataacaatactgagaagacacagatgttacaatcatctgacacatacttttaagcagttattacaacaatgctccatgaatgaaaggataacactcttgaagtgaatggaaagttgggaagtcttagcaagtatctggaagctctaaacactgattttaaacttaaaaattaaaaaatgtattcatcaaaactattaggagaaaaaaaacttcaatgggttatttcaataacaaaattgagacactcagaataaagtcaatgaacttgaaaacagaacaaaaataccaacctaacctgaacaatagagaaaaaggagtgcttttgcaaatgaacagagcctcccggacaaacagaaaaataagaaaaatctaacacatcattgtaatcctgcaggaagaagagaaagaggtcctccagaaagaaaactccgaagaattaatggctgaaaacatatcaaatttatcaaaacactttagaagttcaataaatgtcaagtaggttaaacccaaagaaatccatacccagacacatcataatcaaactgctgaaaactaaggaaaaccataaaaatcttgaaggcagccaaatgaaaataaaagggaaactgccacttgaatgactgtggacttctcatcagaaaccataggggcccaaggaaacatttactaaataccaaaagaaaagacctgtcaacccagaatgctatgtagagcaaaaatatctttcagactaaaggtaaataaatacattctcacaggaaggtaaactgagagaattcattgctggtagaactgctggacaagaattagcaacgatttaagatgagaaaaatgataccagaaagagacaggacaccatcagtgaaggaacgaaagccgaaatagaaaatgtctgggtagacattacagactattattcttctcttgagttccttaaggtatgtttcatgattgaaagcaaaaattgtaactttatctgatgcagttgccattgtatctagatgtgctacatacataacataaaagggtaaaggtaaagggcctaactgctgatgaagtttctatattcaacttgaatggtaaaatattgattctacgtatactgtgaaaggttatatatgtatatggtgatccctagaccacttaggaaccagatttaaataaaccaaaataaactaggaagaagaacatagaagaattaagacaaggggaacaaatgattaataaattattaaaaagtagatctatcggctgggcacggcgtctcacgcctgtaatcccagcactttgggaggccgaggtggctggatcacctgatgtcaggagtttgagaccagcctggccagcatggtgaaaccctgtctctactaaaaatacaaaaaattagccaggcatgaagccgggtgcctgtaatcccagctacttgggaggctgagacaggagaatcacttgaacctgggaggcagaggttgcagtgaggggagattgcaccatggcactccagcctgggtggcaagagcaagactccatctcagaaagaaaaacaatagatctacctaaaaacttatctataaaaacattaaatgtaaatgatctaaaacaatgaattgaaaaccagaaattgtcagaatgtattataaatgaatatgctgactacaggaaagtcactagtaatatacttatatgtgagattaaaagttatatagcatattgaaagtaaagaatgggaaaagatatgtcatttaggcattactcaaagaaagctgtggtggatatattcaaatcagacaaaccagattttaaattgtagaaaacttccagggataaagggggctgttacataattagaggtgccaacacaccagagaaataatgtcccaaatgcatataaggacacagggcttcaaaactcgtaagcaaaattggataatccagataaaaatagaaaaatccaattacatttgcagacgttaacagtcccctctcagtaactgatagatccagtagacaataaatcagtaaacacatttgagacccgaacaacatccatacagcaatggatctaatcaatcaactttctacagcaaaatcacaatttgggtagaaagaagagaaaaaaaataaaagaaaaacaagatcatgctataactaggaaatcaggaatgttcagggtgcaaaagagtgatatattgaaactgacatttttgaaagggttatttagctgtaaatgacatgacacggagactgaaatcgtaaaactggacgtggatcttcccttctccatatttgtcctgccttctcttgaggtctgggctgcttgaatctttagaatctcctgaacttaccacagtgtctggcacagagcatcttccctgtgaatgtgtactgaatcaatggaaaggaattgacaggttcaaaaatgttgtgcaggaataatgtttactatttcacaaatcactggatgtggtgtttgaaggagaaaaatgtgtcaaaagttgacttggaaacaaagcccaaaaggtaagtgaaggggatttggggaatgagatatttggtgtgtgaatgaatggggtgctgtggagaggagtagggagtaagattgtgaactggagcagagaaagaatcacgttttaaaatctaaaacatcttctcctcagttcaagctttgacacttagcagctctggcaccttggaaacaaaacttatctgaggttccattacttctagaaagtccagattaggacacatagttttgttggtgaaactctgttggactacatgaagtaaattcaataaatctcttagtataattaatggcatacaagatttgctttacactttttgtagcaggattgtctccagtcgtgtagatgcaagaggagatagagagtaagacacagtagtatggacaggagacacctttaaagactattttttcattccttcattcgttcagttggtcagtcagtgaactattatggactgaacatgtcctgtgtgtcttttcaaaaaaggacaccataggaggtgtaagagtgattaagatctctgaaggagggagaagtcagatcactgggccacaagagggaaaaagtcagcaaaacaggtacaattgttcttggcctcttgcctcaagatggtcgtcttgttagatgaatactagaaatgggtagattccacctgtcctgaggataaaattctttgggtgcaggattggctgataaagagtgatttccaagcaccattgattgtgttctttgaaagttaggaactgataaagcagcagtgcttgggaaaatagcacgtgggatgtcaattcttgggtgagaaccgccctctttctgcagcaggccacacatcaatctcataatctaaaggttttgagtttgaacatcagagaggatacagtttttgctgctatttcagttgagggaaacaaaatgggtgcactaaataatgaaatgcaaatgctatgagataacagtttgaagactgactcaacattagcttagaatggaaaagtgatttcggttttttggagtttttttgttgttgtttgtttgttttttggcttgtcagtggtttgagtaaaatgagtggtaaagggatatagattacagaagaaactgcaagctatatcatataattggtctttctcactagctgatggaagaaacaggaaattttttgtcgagctttctgctctcaaggttacccaattgtaattatgaggtgagtgggtgaagtcatttattcttttatcctacatgtatttctcgagcacgtatcttgttaagagactgttcggggtacagccattcaacagtgaaaaaacgcatatattcttcacctttgcgaagctagtttctagttgataggggtgaagagaaacagatcagaagcaaacaagaaaaatacataagatgttatgtgacaacgtctactgggaaggaacccacaggcagtaagggacttgggagtgtggagatggcccattcagaagcttttaggagcggaatctgagaagttgtcaccttgaagacatcctttacccaccctccaccccctccccactccccactcctgctccttccttcaatcatctttcttcacgtaggaaatgaggactgtgggattctctggctggatcccagcacctagagagggatctgatcaataagaactgctcagtaagcattacctattgctttggttgccttccccttgcagagtgctggcctcttggattgagcttgcatcataggtgttcagtaggagcttgcttagtggatttacaggttgaggttagaacccaccgggattctcttcctggaaagaacaggcttccctctaaggtttcacatagaccccgagtgaggaaagagccctaaattgcttgaaaaattgattgctctttgggcaaaacaagaaaccctcctatggaagggcatcatttgggcatatatcggggtctcagtacaaagatgagtgctcaagaggtcaagatgcttaagcagagaatttcaccagaatgttcgtggtacagagaaacagtcttgttgggagaaggatgacaattgaggccttggaatataagctaaataagcttcaaaggggatacaaaaaagaatcaggcacaaatcctttactacattattttgtacagctcaatttttgcctagaaaatcataccttactttgcatccctattgtgttcctccaccatctattttgtttttttaagcgttatttcatttttatgttcacagaagcttgttgctacaactaaatgagcaaaacagccagtagcaacagaaatgcgttactatctctcctcagaccttgaaagcattttccttaaaggtgaacaatattccacatacaaggaggttttcagcactatgtgctagaaattatactgaatgtttcttaatttttacgtaagtcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacattaatgtaatagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctggggggcatatagagccactcagagccttagaggtacgttcagtgaaatggagccaatcaccatatagtgtagcctattgttcgtctgaccaaaatgcactatgttgcgatagcatggattctacagacccgtgaagcccatttggaccacaagacactctttccatcatgcctgcacacctatccttcactcttcattggctcatgcagacttttgaaagtatttagcaataagcatcctacccccaagaagcttatggtctcatggagaagatggccaagcaacagacaatcccaacatggtgaatgccgctaaaacaaatgcgtacctggatctccgtgagtgctaggaggaaagcaacccaaactcagaaaagtaggagaggtgtcagggaagacattttccagaagatggtttcgtgtctaacaaagccgtgagacgagcaaagaggaggtgaaaggctcagcgttctatggggacatttccttaagtccagtatctctagagttgagtgagggaagctaaaagagaggaaatagaaatgaaaaatgggagttcttgagaggctttacttaccctgcacaagccaaggacaggtctgcgggaagtaagcagatgcacagttaggaaagcccatatcaggagttagtcacgacagagaaagatttgtacactttggaaatcgtaaaagaatgaaaagcccaggtccttatttccctgttttcgtctctgtttttcacgttcctcccggatttcaatttctttctggaatcttagctctcttcgtcatctgctcttgcaggaacactgaactgcaaacgcaaccctacgattcagcgaactacgtcctatcaaggttactgggtacaaatacatttactttcgtgagttctcttgtgactttctgtatcactgcccacagttgctactgtgagacaagcattagaagtctgtgtagattgctgggttcacacacatttacattctttttctcttgtgagctttgacgtggctacacataattgttactgtgaaataaacattagaaaagcctgtggcccgtgaaataaacattagaaaagcctgtggcccgtacggggatcgaacccgcgaccttggcgttattagcaccacgctctgaccaactgagctaaccggccccgccggcggaacggaccctacctctcttgagaagtttaaaggcgaacgttattccaatcaccaaagaaacttttctgaagttcttggagttggaaagaacctacgatctttgctaacttggttacgatcctcggcaaatttcttctaacctggaaatttcagttaaaatacaattctgcggaaggaaagttcaaatgtcacctgcttcagtgtttcacgacaaagggtttcagtgaccacccttttaaacgcaacgccatcaccgtccgccggtactgtggcctgtccctatcactcctttctactttgcttccgtagcttctgagcgacccgtgaagaaattgacggaaaacggaaggaattgccgccagttcctttccacgggccgtcaaggccagtataagtccccacccaggctcctctgctcgtaacttctagcacgattcccactgaattcgcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacatttcgaataactgaataaaggaaatctcaaccaacccccttgccgtattacaggtggtccagctctctgcctagactattgtgctaatgtcctgttccttctcccggcttttgaactagattctcacctctctccaatccatctttcgcagggctggcctgtctttccgcctcacttctgaaattctatccattgcagcctctatgcaaaccgactctggttaatacttcagtcggtatggctcccctcttccgcactttgcactgcgagaaatgcccttccttgaggcagctggaggcctcctcctcctgagagcttaattgtggacacagtcttgagtagaggcgaaaaggaaagaaggctgggagataatgggggaaaagcacacctttggtctggtttgaaagctggcgcccgaaaaggggagcgaaaggacaagaaaaaaaaacacgctccgaaagtgtctgagattgctgcggccataaagcagagcactaaccgcggtactgataagggaggggagcagggctccgccgccgggcctgtgcccatggatctaggtgaggacgggcactccttcctccgcggccaaatgttgcatttcccaagaccaccctggcccgccacgcccccatcctgtgcctataaaaactcccgagaccctagcgggcacggacacaagcggctggacgtgaagaggaacacaccggcgggagaacacagaacacccaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgagctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaaaaacaaaaaaaaacaagtgttctagatttgcagaggaccttttcggagctaagttccagtagctatactgtaagttgatttcttgggcagttctgttggtgaggaaagagggcaaattgagaaatgaacaaacacagaagttgcaaaagccctgtgacttacagcacaggacgagtctacaaaccctgccataccacactaagctcaaattgttttaacaccagcttactcagacccgatgatccaagataagaccaaagccaaacggatccagcaactctgcgcagatcttcatgttccagcagctaagttccactgaataaacctatgattcgcctagtttagaaattctggccgtgcgcggtggctcacgtctgtaatcccagcactttcggaggccgaggcgggcggatcacaaggtcaggagaccgagaccatcctggctaacacggtgaaactccgtctctactaaagatacaaaaaaaattagccgggcgtggtggcgggcgcctgtagtcccagctactcgggaggctgaggcaggagaatggcgtgaactcgggaggcggagcttgcagtgagccgagatcgcgccactgcactctagccgggacgacagagcaagactccgtctcaaaaaaaaaaaaaaaaaaaaaaaaagaaaagaaaagaaaagaaaagaaaaagaaaaagaaattctgtccagtccctcctgagaaggaccttactaaccttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcatttttgtcatatgacactacttgtattttacaggattcacttggtctccatctgacctcctcagagtagactgctctttcccaatcactcctgcaattaccctaggagatgtgtgatcctaaagtaagggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaatataaaggcaagtatctttttcactcagttcaccttggttctaagagtgggtctatataaagaaatggagcatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaattaatcatgttataaacaatatgaacataaaagcaaaaattgcaaggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctaatgcatctacaaaaataagcattataagtaaatgcagctatgtcacagattacaatatacaaaaattaattgtatttctatgtactagcatcaaaaaaatggaaaattaaattaccactttcaataggtttaaaacaaatgaaatatttagagataaacttgtcaatgtgcacaagacttgtacctagaaatctactaaagattgctgagaaaaactcaggaaaacctgaataattggtggtgtttgccatatttacagattgagaaatttaatattatttagataactttttttttctctgagttgatctatagatttagtacaatcccaacaaatatcccagcaggagtttttgttttgttttgtttgtttgtttttacagaaattgacaagcttattctgaaggacttagagtaacctaaataattaggaaaagaaaaacaaagttagaggacttacaccaagtaatttcaagacttactataaagctaaggtaatcaaaataatgtggtattgtctcaaggatacttacccagattgatggaatagaatagatagtccagaaatagaccaatgtatgtggtcaactgatttatgacagaggtaaaatgtttttttaaacaaatggtcccaggcaactgagtatggaaaaaatgattccctacccttaactcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaaaataagatgcttatatggccaataaggcacactaaaagatgttcaacaacattaatcagtacaaaaatgcaaattaaatctatcaaggattaataggtaacaacagatctcaactcccctgaatggagaaacaattagtaacacagatactagataagttacttgaaggatcaatcgataaaaagatacttgggcttatttccaggtttgtgttcttaaaaagtgatgcattcaacagagcatttgaggtaactgctaattagggacggtacttccttctctttcatctaatgggagagtgaaatcagattagaactagtgctttcctaatgagatcttttctctctttctcaggatcccgactcagattgaaaaagcagaggatggtcactgccttccaggtctgaggctgtctcccagaaacttcattcctcgcttcgccttggtagggaagttcccggaggtgtttgaaaagctggaaacttaagtgggacatggaacgatatttgtgtcccggttatcaaaacaggcagaaaagacaaatgcggtgtgggggaattggctcaagcggtagagcgcttgcttagcatgcaagaggtagcaggatcgacgcctgcactctccagcttcttttaatccctaggctaccaatggtatctggtaaatactttcagcggatttaccgctctttatttgactcagtttcatcttgttatgtacattttttttttaaggaaattatacatagcattccatgcaaaagcaaaaaaggaagcgattagtcacaagtgagttttgccaatacaggttttggggcttcagctcgaagttaatacaatgtatttttgtggggaaatcaaactttagccttttgggtacaaaatatgaggaacagcctggaaatagtgtcaggaggcaaaagcaggagacttgaatgtgccaaccttttgcttttattcacattgacaacacatggtcaggtagaggatgaaaacgtgtcttctaccagattatctgagagttggccaggctcccaccttcacttatactccttccttacctctctcctgtgtaggtaagagaggtaaggagagaggtaaggaaggagtataagtgaaggtgggagctagcatattaactctagtggtcggatacactctcactaagaaaagtgacatttattccttctattcatctctctgaaagctcgttctgacaaaaatgtgctcaaaataaatggggacctaggtcttcctctaatttccaagatgaaccaaaacgtaaaaaaatgtatttttgaaattgcaacactatcccctatttaaagaaactacatgaggcgctgtattaacaacacatatgttgactagctcaactggcccaagcagagctcagaatgctggagagagtggtctttggatagatgactccaggaagctcttgtaggtccctgggacgtgcccctctttccatccttctttctttcccatcactcaaatctctctctgacaccatttgacttctcagcattgccctttgttaatcgtaatagaaagacaatgttattgattacatgtttttctattttatcttcttattcataaatgatctcaaaaatgaatgtcataaataataaacatgttgttgaatttttgtcccataggagcagcctctttccttctcaggatgtgcactcctaataaactgggaccgtgaaggagggacctgaagctgccccaaaccacctgcagttccatgaaggccatgcctccacccactaatcactctgaaagtagtgcccctccactcttccccaaccacatttccttttcaggcaaaaacatttctatgggtttgttagaccctagcttctaatcctttcttcagtctttactgatctgaagccactctctcctttgaggcttctaaattatctgtatagcctttctccattcagcaaattttcatcaggcaaaaatcctacttgacgctagttatactcagagtaaaataactatgttcctgtcttaaatgagaattcttcacaggtggaaagcagatttggaatccactacaactccaaggcagtggagctaatgtagcctcccctgggctacaggggaagccttcttctgtgggcccgggaattgaagaactagacaggcataagaaggacaagtgtggtgcccaatggagcaagagaaggggggaggaaggtgacagggaagggaaatggcaggagaagcacctacacagcagacacggtatagcctgcatctgtttttccttttggctgagagatccctgagctctgtggtgacaattttccataatttttcatataaaaaatgaagattataaactatttctaggcattttacctgcattactattaatatgtgtacagcatctaaaatagggtctagacggcaattgcacagtactattacttgctattgttgtggcactttctatgtggatcactggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggcgcgtatggcgtgaagttctggggctgggagaagctgccccactacttccgggcggccttgcctgcagggagcaggtgaggatcacagctctagagcgggctgcaatagctgtgcccgcaagccaggcagttccgggtggtgcttctccaactggaacgtgctctctacttccgagagatgaagaaggcgaaattgagaagtgaggagagaggtctccctcatgacctattttggaaatccgtattcttcacactctcaggctcgtagaactttgcccaaggcagtatctgagaagctccgccctcaatcttgtcctgccagggatttggcggcccaaagtaccggcaggctcctgataaccaggaaaatgggtggggggtggtgtatcctcagtggggaattagctcaggcggtagagcgctcgcttagcatgcgagaggtagcgggatcgacgcccgcattctccagttccttgtccggtttatgtctcttggtttgtatacccgcttctttctcctgttgacaacggcggtgcttcttacctgggagaagatcagaggaacctgccccctcccccgatctcgtgttttactgctccccatgtaagagtcttgttgcccctgcttccatcctcccatgttttccactcctgccacaggtttggcacttctagctactcaggtctcaatgcaaatttcccgtctttagacaagtacagctaaaagtgatgcccacacgatctctcaattcctactacatcttcacaaatatcgtctcctccagaaagtatgtctttaagttactggtttgtttttctctcccctagagtgggagcttcctgagtaccgaaacgctgtctatgtacactgtgttcaactcgcttcatccccatgcgtagagttaaggttctgtaaaatacggttactgccttgaacagataaggaaacagggagatcaaagacagagcaatacttaaaaacattatcctgccacatttctcaaatcttaataatagcattcactaatgtttttggtttttctttgtgctttctccatatccccttattattattattattttacatttggctgaccattttacacttctttttcaaatgaccaatcagattttgcaattttctagttaattcctgtgtttccttcaccattctattttctttttttttttctttttctttttttttttcgggcttcttcttcttcttcttcttcttcttcttcttcttcttcttcttcttcttcttcttcttccttcttatatttaatgcactgatttcttctaatgttttgtaacttgggtattaaaaggtgtaatttaaaatgagaaagcagtttctacagagtccttagaaatatgtcattttaagtccccattttcattatattctaaggagctcgaagatatacttttgattcttttctaaactgtgcattcgagagttaatctcttcttgtttacttttacgttcattctttcaatgttattttctaatttttgtgtatcattttgtttatcaacacataaatatgtacattcacataagtatacgagttatatatacatgtatttatgaatggcagctgaaccacacattagtgctaatattggtgactaaaagttggagaaccagacattatgtacctcataaagcgaagcaatggaaagtgcacaagcccacctatcaaattgtcttgttaaaagatttgaagctgaatctaagtgagcctctacttgtaactaccagtttacaagaaatagagtaggtgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgttaaaaaaaaaaaaacccaggatgtataacacaaagagcaaactgtaatgtaaactgtggacttcagttaacaataatgtattagtaattactggtttaccagttgtaacaagtgtaccatactgatgcaagatgttaataatagggaaaattgtaagagaggtagagtgatggagtttatggaaattctatctattctggtcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaaagttaatattagatcatatttatgatctattaccaatttgttaacaacaagtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggacgtggtagcgcacgcctgtaatcccagctactcgggaggctgaggcaggagaatcgcttgaacctggaaggtggaggttacagtggatcgacatcgcaccactgcactctcaaaaaaaaaaaaaaaaaaaaaaaaagtctttattgaaagtttcaaacttaaaagtgctctcacatataaataaaatcattttctctatatacatggtttttgcaagtgtacatgtctagacaccctaggaatggtggtgccgtggtgtgaacgtggagcctggaatggccagccccaaaacctcctcctcatcaactgttgactcgtcaacagtcagtcagtaatcaaaacttccttaaaatacaaagagccgcagaacattccgggatatctgtgctacttaatctggcagttcctactgtgtcttgcccccggtgtgacgtgctctcttccatgaaattaataactgcaaactgtaatgggaacaatgcaattgattgtctccgcactcttgcccaaagcgttctctgagatgtttggtagttatttgggtccttacttgaccttcgtggccttaaaacaaagggaacatggcatttgtgaatctgaaagaattgtgataattttctcatttcctcctggctgtgtgcatcaccctgagtttgcggagggatcagccctttttcagagccccctcacgtcctgagtatcatcctcagaatgtggggcttgggctcaatttgaagagggtgtgagggagagccaaaatgcagggattgtcccacagtgcagtcctgctttgtaaaccccttcctctgactagcttgattttagtctctgagaatggatggggtgggatggcttttcagtactttctgctgagacatttttgtatattcatttctctctcaaggagcctctgtaacaaaagagaaaaaactgtctcgggttctgtgtgtggcacatgagtttgaaggatttctgagactattgttcaggactggcgttacagatgaaatatagattcaggaccagtgacggtgggatccttggcaggcggacataacgcctcgttaaggacagactgcccaccactctctttctttctttctctctttccgaaatcattttctataaattccactgggtatcagaaccttccttaggctgactggcgcttcgcagtctcctctccaagcccggatctattccccaaaattctctcgttcatgcttctagcttctcttcttagcttctctaggttcgcgtcatcggctttccttgtttcccaggttgaatccccagttccaagcggctcctgtaacagggagtgggagcccaccctcccactcgccgtgtagcactctgcatctctgagaagaaagtgaccaccccagcccagcacagattttcttcgtctttgagcacctgctcggagttcccgcccctcgtcgctccttggttttccctcattgcctacatagagtctgttggatgtcggtcaaggtatccccagcccctgccgtgggaaccgtttggggaaaaacagacctgatttatttatacttcaaagatgcccaatgattccctgtcgtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaagtgagcgggttacaaattccgctaaccccagcccgccaccccgctattggctatttgaggcatgtgggggatttttccggactagaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaaggtaagcgttcacttgcaaaagctgccctctctgaggctcgaactcaggaccttcagattatgagactgacgcgctgcccgctgcgctaagagggcgacgaagtgcatcaacgcgccagcttccacaggaatttcctaatttctttccccaggcgggttattttgggacttcagttttcttcgcccaaggtcgctagttttccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctctcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaataccctattaaagattttattcccgtaatttcatttagtccaatttatttatttatttatttgccataaatctatacatcattatccccatcttactgatgaaactgaggctcagcagaactaaatccacagctgataaggggcaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacctgccatgtacccggcatttatgctctagatttccaaggcatccttggccctttatccctcacatccctacaaacaccttaaatcattagttctcgaagtgcggtgcccagacccaccacataattctcgaggacacattccatttcaggtactgtgctacccgaaggctttgaggattcagaggaaattgagccatccctgacctcaggagctgacaggacaaactgtcctatctggtccggttcctatactctcaaacttccggattcttataaatgcatcttcctaaatattttattttgatactgtaactcccattctgcactagtttgctagggctgccataataaatatcatagactgagtgccttaaccaacagaaaattttctcagttctggaggctagaagggttgttagctttggtttctcctgaggcctctctccttggctcgcagatggtcacttaccttcttgctatattctcccacggtctctctctctacacatgtttccatcttttcttataagaactcctattgggagttagggtttcgacatgaatttgatgacaggtggggcgggacaaaattccaccatgacaggctcaaagttgtttacattttcaccctcatatttgcagtagactttgttactggaaaacactacttgcttttttttttttttaacacgtattttaaagccccttaattaaacagaccatatacctttccttatctaggaattcccattccagtgcctggtccacacatccattatttctcctcatctccattcctcaaggcccattcttgattctttcattcttatttgaaagaatgtagcatggaggaatgtagcatactagtttttccctcggaattgcatgactcattgtcatgcaaattacgcagtctcaggtgttccttttagcaacacaaagtagactaaggtgtgtacatttttgtacttgtcaaatgtggttagaataccaaatgaggtactgcctcacagatccctgagatgtcattacttggcataacaaaatcataatatagatatcataataatgcataagcagacaggaaaaaaccataataataacaaaactcattaagggatagccacgtaagtttatcagttagttctctctaaactctgtaatatgaatgtggccaatctctgggatttaataatacaaaaaacatgttttggtctcccagtgtcattttaatcttattcagtaggatatattctttccctatctccatatgaagacatacacagttttatgcctcatcccaggcaatacagtctcagtctcaaagttaagatgctgagctccatgtaacactctaaaatttaaacttgacataaagatcagatctcttcctttacctactgggcctgttgagtcagctaaaactatttggatagttttctaaggaaaatgtttcatctctcttttcttaccctaacattctaccatttgttaaccactgttctgagacttccgtgtttcaatcgtggtggaagatgagttaaagccagggaggggtggtggggagaataataaagttcttacttttaaatggtgttgtcattagccagtgtcatgctttccattcagctgtttgaatacgaataatttttttaatacgatccatgattgtggattctcgtgtgcatttcccttgatgatgatgtactctcctgtacccccttctttatgactgcttttccagccactgcaaaactcaaagcttccttttgcttctttttccttagttacgttcatccttccacatagcccactgggactggctcaaagttgacctcatgctagtgctccctctctcctgattcccacacctgtcttgtgggaaaggcctacatctggttgtccctgaaaagccctgggactacaggccaatcccaatatagaaggaacttcaggcagtcaatctgcccatttctcccctttacatttctcatgcatctaactaccgtatctcccatattttggtgccagtgattgaacttgttggcacctgtattagtccattgtcacactgctataaagaactactggagactgggtaatttatgaagaaaagaggtttcattgacccacagtgccacaggctgtataggaagcatggctgggaggcctcaagaaacttacaatcatggcggaaggcgaaggagaagcaagcatgccttaccatggcagagtcggagagaaagagcaaaggggaaagtgttacacacttttcaacaaccagatctcaggagaactcactcattgtcatgagaacagcatgagggaaatctgtctggaacaggtttgtgaacccattgaggtgttcatccagtgctgtttcagagaaatctctatttcaatctattcctatacattagttactgaaaaacaacagacaatcacaaaaacaagttgacctttttgtgatccttgagcccagttgcgaagggccctcgtgaccgggcctcatgccaaacaactcgttacaaaaagagctagggttccagactgggctgaagcttcatgagacttctcctcgtctgtgcgcagacagctggccaactctggagcccaggctgttgcttcccggtctgttggtgaatcctccatagtctggtgagtgtacatatatatgtatatacatatatatatatatatatatatatatatatatgtctttttccttcccattgcaatttgcttattatatcagtctgcttattatttcatttgcttattatatctgcattgccatttacgtgggataaaggttgtttacccttaaaggtgttgtgtgggtgtcttttcttctccctttacatgtcttccacacagaacatgtacacatgtatctacaggtgcatgtgtgtatgtagaagtgattgcacctgtgtttatgtatacatgtctgtgtacaccacatgcatgtgtaaatgtatgtgggtacacgtgcatgcatgtgtatgcatacatgcatgtacacatgcacaaaggtatctacacatacatgtgtatacatgcatgcatgcatgtttatgtatacatgcatgtacaccgtatgtatgtgtgtatgcatgtgtgtattttcagacgcatatgcatatgcatacatgcatgtacttgcatgtgcacacgtagctgcacattcacgtgtgtatgtatacatgtatgtacacgtgtgtgcatgtgtgagtgtgtaaagatatgtaaacatgtatgtgcaaatgcatgtgggtgtgtgtgcatggatgtaggtgtatccatgtattgtgtacacagtatgcatgcatgtatgtgtgtagatatatgtgcagatagacatgtgctcacacgtctgcatgtatgtgtgtacatgtgtatgtgtttacccacgtacgtgtgtatgcacgtgtgtacgcatgcatgtacatgcgtatgcatgtgtgtatgcatgcatgcacatgcgtatgcatgtgtgtatgcatgcatgcacacatgtatgcataaatgtatgcattgtgcacatgtatgcacatgtttgtatgaatgatgtatatatacatacacgtatacaccatgtataccagcctacaaatgcatctgtgcacacacatgtgaaggcgtgtgtatgcctgaatacaagtgtccatacatacgtgtgcatatccacacatacatgtgtacaacacgcatgtgtgcacacatgcatgtgcacacacaaaaattcgtgtgcaaacacatgcatgcatgacatatatgtgtacatggatatgtgggtatacatgcatgtgcatacacacgtgcacgtgcatgcacacatgcacacataatacatgtatatatacatacatgtttgcgtgaaaagcacgatgcatacatgcacacaaacataaatgtgcatacgcacgtacttgtgcatacaaatgcacatgtgtacccatacatgcattcagacgtttgtgcaatgtatacatacacctataagtacatacacacatatacactcatacatgtttgcacacacgcatacgtacacacatgcacgtgtacaaatacatgtgtgcgtgtgcatgcatttgtgcatattcattgattgtgtgcacaatatgtatgtgtgcatgtatgtgtgtatacgtgtatgtgtagatgcatacgtgtatgttaacatgcatgtacactcatgtaaacatgcatcaacacatttatacacgtatttatttgtgtatcaggtttgtatacacgtacctaaacatgcatgcgagcattcgtgcatgtatgtacacgagaatgcatatgtgtatgcatacgtgtatgtacacatataagcacaggcatctacacgtgtgcgtgcgcacctatgtgcacacttatgtatacatgtatgtgcacgtgcataaatgaattaagaaagaaacaattcacccaaacaaggaggaaaagatgaacatctcaagtacctatgagcatttttacatgcagaccccttactgacattggccaagacagatgacaagagatcatcaaggagagagttcattagaaaaagatactgctaacattagagaaacatagcatcaatcacccatagcatggatgctgttgagcttccacctgaaaaacaaacaacaacaacaacaaacctggcgggtagaaataggaacaggtttagcattacatccctccctccttttcctgggacctgcattgggccccataagcttggcatgaacctaagtgaataagacaccaaaggactgaagtttaccactaccttcagaattaggactcagagccaggaatttctttagactacataaccagtctatgcatatgtgaggatttggactgtagttcacactggctgcgcttccttatggaaacagtgactacaagatggaggatattaatgaaagatagcacacatctatactaaatgtcataacagcaaaaaccataagatagttactgacaatgagtcatgcaattccgagggaaaaactagtatgctacattcctccatgctacattctttcaaataagaatgaaagaatcaagaatgggccttgaagaatgaagatgaggagaaataatgggtgtgtggaccacgcaatggagtgggaattcctagataaggaaaggtatatggtctgtttaattaagggactctaaaatacttgttaaaaaaaacaaaaaaaacagcaagtagtgctttccagtaacaaagtctactgcaaatttctttctgtacatgggaaataaggactgtgggattctttgggtggatcccagcacctagagttggatctgatcaaaaagaagtgctcagtaaacatttacctactgctttggttgccttccccctgtggagtgctggcctccaggattgagcttgcatcataggtgttcagtaggaacttgcttagtggatttacaggttgaggttagaacccatcaggattcttttcctggaaagaacaggcatgtgttcttcccttccctctaagttttcacatagacactgggtgaggaaagagccctaaattgcttgaaaaattgattgctctttgagcaaagcaagaaaccctcctgtggaagggcatcatttgggcatatatcggggtctcagtacgaagatgagtgctcaagacgtcaagatgcttaagcagagaatctgaccagaatgttcgtggtacagagaaacagttttgttgggagaaggatgacaattgaggctttcgaatataagctaaataagcttcaaagggtatacaaaaaagaatcaggtacaaatcctttactacattcttttgtacaaatcaatttttgtctagaaaatcataccttactatgcatccctattgtgttcctccaccatctattttgtttttttaagcgttatttcattttcatgttcacagaagcttgttgctacaactacatgagcaaaacagccagtagcaacagaaatgcattaatatctctcctcagacctttaaagcattttccttaaaggtgaacaatattccgcatacaaggactttttcaggactatgtgccagaaattatactgaatgtttcttaattttcacgtaaatcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacatttatgtagtagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctgggggcatatagagccactcagagccttagaggtaccctcagcgaaatggaaccaatcaccatatagtgtagcctattgttcatctgaccaaaatgcactatgttgcgatagcatggattctacagacccgtgaagcccatttggaccacaagacactctttccatcatgcctgcacacatatccctcactcttcattgattcatgcagacttttaaaagtatttagcaataagcatcctacccccaagaagcttatgatctcatggagaagatggccaagcaacagacaatcccgacatggtgaatgccgctaaaacaaatgcttacctggatctccgtgagtgctaggaggaaagcaacccaaactcagaaaagtaggagaggtgtcagggaagacattttccagaagatggtttcgtgtctaacaaagccgtgagacgagcaaaggggaggtgaaaggctcagcgttctatgggacatttccttaattccagtatctctcgagttgagtgtgggaagctaaaagggaggaaatagaaatgaaaaatgggagttcttgagaggctttacttaccctgcacaagccaaggacaggtctgcgggaagtaagcagatgcagttaggaaagcccatatcaggagttagtcacgacagagaaagatttgtacactttggaaatcataaaaggatgaaaagcccaggtccttatttccgtgttttcgcctgtttttcacgttcctcccggatttcaatttctttctggaatctcacctctcctcatcatctgctcttgcaggaacactaaactggaaacgcaaccctacgattcagcgaactatgtcccatcaagattactgggtacaaatacatttactttcgtgttctcttgtgactgtctgtatcactgcacacgtttgttactgtgaaacaagcattaaaagtctgtgtagattactgagtacatatgcatttctttttttttcttttttttttattatactttaagttttagggtacatgtgcacattgtgcaggttggttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtaattctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatggtatctcatagtggttttgatttccatttctctgatggccagtgatgatgagcattttttcatgtgttttttggctgcataaatgtcttcttttgagaagtgtctgttcatgtccttcgcccactttttgatggggttgtttgtttttttattgtaaatttgtttgagttcattgtagattctggatattagccctttgtcagatgagtaggttgcgaaaattttctcccattttgtaggttgcctgttcactgtgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggttttcatggttttaggtctaacgtttaaatctttaatccatcttgaattgatttttgtataaggtgtaaggaagggatccagtttcagctttctccatatggctagccagttttcccagcaccatttattaaatttcttttcttgttctcccgtgacttttgatatcactgcacacaactgttactgtaagatgaacattaaaaagtcacgtctggccagtacggggatcgaacccgcgaccttagcgttattagcaccacgctctaaccaactgagctaaccggccccgcttactaaaaccccccctaaacctcttgagaagtttaaaggcgaacgttatttcaatcaccaaagaaacttttctgaacttctcggaactggaaagaacctgcgatctttgctaacttgtttatgatcctcggcaaatttctccgaaccctgacatttcaattaaaatacaattctgaggaaggaaagttcaaatgtcacctgcttcactgtttcatgacaaggggtttcagtgaccacccttttaaacgcaacgccatcaccttccgccggtactttggcctgcccttctcactcctttctactttgcttccgtagcttctgagcaacccgtgaagaaattgacggaaaacggaaggaattaccgccagtttctttccacgggccgtcaaggccaatataagtccccacccaggctcctctgctcgtaacttccagcacgattcccactgtattagcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacgtttcgaataattaaataaaagaagtctcaaccaacccccttgctgtattacagatggtccagctctctgcctagactattgtgctaatgtcctgttccttctcccggcttttgaactagattctcacctctctccaatccatctttcgcagggctggcctgtctttccgcctcacttctgaaattctatccattgccgcctctgtgcaaaccgactctggttaatacttcagtcggtatggctcccctcttccgcactttgcactgcgagaaatgcccttctttgaggcagctggaggcctcctcctcctgagagcttaattgtggacacagccttgagtagaggcgaaaaggaaagaaggctgggagacaatcggggaaaaacacacacctttggtctggtttgaaagctggcgcccgaaaaggaacaagaaaaaaaacacgcttcggaagtgtctgagattgctgcggccataaagcagagcactaaccctggtactgatacgggaggggagcaagactccacccccgggcctgtgcccatgaacctaggtgaggaggggcacttcttcctccgcgcccaaatgttgcatttcccaagaccaccctggcccgccacgcccccatcctgtgcctataaaaacccccgagaccctagcgggcacagacacaagcggttggacatgaagaggaacacaccggcgggagaacacagaacacccaccctctctttagtcaccctggaggcctcggagaaggcggtttcagtgatccgtgaagagaccctgagtcttttacatcccggagaatgacaagagagtacctgggcgacgtaactttctgggttttccggagatgcggttttctacacgccaggggccaagcctgagaaataggtggacggcaaggacaggagctctctccgcgccacaaacgcccctgctcacacctgggttccttgattttcctgcctatataaccgagccacccatggccgggctccgagctctcattctgcggactgggacaaaggggttaactgtgatgtgctttgtataaccccaggattctgcacttgcccaagggcgaggtgcaaatccaaaatcacgcacgactgaacgccgagatcagctgagtcctgagtgcctcacgacacaaaatccgtatgatttttaaaagcgctgtatttgtgctgacaatgcatgtcagatcccatctgtctttagctcaatgtgtgacgttagacacgtcgttttgctcctcaactttcttatttggaaaaaaaaaaacgagtgttctagatttgcagagggccttttcagagctaagttccagtagctatactgtaagttgaactcgggcagtcctgttggtgaggaaaaaggacaaattgagaaatgaacaaacacagaagttgcaaaagccctgtgacttacagcacaggacaagtctacaaaccctgccatgccacactaagctcaagttgttttaacatcagtttactcagacccgatgatccaaggtaagaccaaagccaaacggatccagcaactgggcagatcttcatgttccagcagctaagttccacggaataaacctatgattcgcctagtttagaaattgtctagtccctcctcagaaggaccttactaactttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcgtttttgtcatatgacattacttgtattttacaggattcacttggtctccatctgacctcctcagagtagactgctctttcccaatcactcctgcaattaccctaggagatatgtgatcctaaagtaacggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaacataaaggcaagtatctttttcactcagttcaccttggttctaagagtgggtctatataaagaaatggaacatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaagtaatcatgttataaacaatatgaacataaaagcaaaaattacatggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctagtgtatccacaaaaataagcattataagtaaatgcagctatgtcacagattacagtatacaaaaattaattgtatttctatgtactagcatcaaaaaaatggaaaattaaattaccactttcaataggtttaaaacaaatgaaatatttagagataaacttgtcagtgtgcacaggacttgtacctaggaatctacaaaagatggctgagaaaaactcaggaaagcttgactaattggtgttgtttgacatatttacagattgaaaaaggtaatattattaagatatcatttttttccctctgagttgatctatagatttactacaatcccaacaaatatcccagcaggagatttttgttttgtttgttttgttttcttttctttttgtttgtttgtttttacagaaattgacaagcttattctgtaggacctagagtaacctaaataattaggaaaagaaaaacaaagttagaggacttacaccaggtgatgtcaagacttattataaagctaaggtaatcaaaataatgtggtattgtctcaaggatacttacccagattgacggaatagaacagatagtccagaaacagaccaacgtatgtggtcaactgatttatgacagaggtaaaatgtttttttaaacaaatggtcccaggcaactgagtatggaaaaaatgattccctacccttacctcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaatataagatgcttatatggccaataggcacactaaaagatgttcaacaacattaatcagtacaaaaatgcaaattaaatctatcaaggattaataggtaacaacagatctcaactcccctgaatggagaaacaattagtaacacagatattagataaagataagttacttgaaggatcaatcagtgaaaagatacttgggcttatttccaggtttgtgttcttaaaaagtgatgcattcaacagagcatttgaggtaactgctaattagggacggtacttccttctctttcatgtaatgggagagtgaaatcagattagaactagtgctttcctaatgagatcttttctctctttctcaggatcaggactcagattgaaaaagcagaggatggtcactgccttccaggtctgaggctgtctcccagaagcttcactcctggcttcgccttggtagggaagtttccggaggtgttcgaaaacctggaaacttaagtgggacataagacgatatttgtgtcccggttataaaaattggcagaaaagacaagtgtagtgtgggggattagctcaagcggtagggtgcctgcttagcatgcaagaggtagcaggatcgacgcctgcattctccagcttcttttaatccctaggctaccaatggtatctggcctagatgacagttgcacagtactcgttattgttgtggcagtatctatgaggattattggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggctatgccgtgaagctctggggctgggagaagctgccccaccacttccgggcggcggtggcggcaaggagcaggtgacgatcacaactctagagcgtgctggaatagctgtgcccccaagccaggcagttccgggtggtgcttctccatccagaatgtgctctctgattccgagagatgaagaaggcgaaattgggaagtgaggagagaggtctccctcatgaccttctttggaaatccctattcttcgcactggcaggctcatagaactttgctgaaggcagtatctgagaagctcggccctcaatctggtcctgccaggggtttggcgacacaaagcaccggcatgctcctaataaccaggaaaatgggtggggtgaaaagtttctcctctggggaattagctcaggcggtggagcgctcgcttagctatgcgagaggtagcgagatcgacgcccgcattctccagtttcttgtctggtttatgtctcttagtttgtattccccgttgtttctcctgttgatgacatcggtgcctcttacctgggagaagatcagaggaaactgccgcctccctagagcccgtgttttattgatccccgtgtaagagtcttgttgcccctgcttccatccttccttcttttccactcctgccacaggtttggcacttctaggtactcaggtgtcagtgcaaatttcccgtctttagacaagtacagctaaaagtgatgcccacacgatctctcagttcctattacatcttcacaaatatcgtctcctccggaaagtatgtctttgaattattggtttgtttttctctcccctagaatgggagcttcctgagtaccgaaacactgtctatgtagactgtgtttaactcacttcatcaccatgtgtagagttaaggttctataaaatacggttactgccttgaacagatgaggtgagtagtataaggaaacggagatcaaacacaaagcaatacttaaaaaaattacctgccacatttctaaaatcttaacaatagcattcactaatgttttttggttttcctttgtgctttctccatagccccttattattattattatcattgacatttgactgacaattttccatttgttttcaaatgaccaagcagattttccaattttctagttaattcctgtgtttccttcaccattctattttctggttttcttttgggctaccgtcttcttcttcttcttcttcttcttcttcttcttcttcttcttcttcttcttcttcttcttcttcttcttcttcttcttcttcttcttcttcttcctcttcttcttatccttttccttcttctgcttctgcttcttcttttcttctttttcttacttcttatatttgatgcactgatttcttctaatgttttgtaacttgggtattaaaaggtgtaatttaaaatgagaaagcagtttctacagaatccttagaaatatgtcgttataagcccccattttcattatattctaaggagctcaaagatatacttttgattcttttctaaactgtgcattcgagagttaatctcttcttgtttacttttatgttcattctttcaatgttattttctaatttttgtgtatcattttatcaacatataaatatatatattcacataagtatacgagttatatatacatgtatttatgaatggcagctgaaacacacattagtgctaatattggtgactaaaagttggagaaccagacattatgtacctcataaagcgaagcaatggaaagtgcacaagcccacctatcaaattgtcttcttaaaagatttgaagctgaatctaagtgagcctctacttgtaactaccagtttacaagaaatagagtagatgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgtttaaaaaaaaaaaacccaggatgtataacacaaagagcaaactgtaatgtaaactgtggactttagttaacaataatgtattgataattactggtttaccagttgtaacaaatgcaccacgctgatgcaagatgttaataatagggaaaattgtaagagagggagagtgatggagtttatggaaattctatctattctgatcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaagttaatattagatcatatttatgatctattaccaatttgttaacaataggtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggatgtggtagtgcacgcctgtaatcccagctacccgggaggctgaggcaggagaatcgcttgaacctggaaggtggaggttacagtgaagcaagatcacaccactgcagtctcaaaaacaaaaagtgtttattgaaatttttaaacttacaagtgctgtgacatttaaataaatcattttctctacatacacggtttttgcacttatacatgtctagacaccctaggaatggtggtgccgtggtgtgaacatggagcctggaatggccagccccaaaacctcctcctcatcaactgttgactcatcaacagtcagtcagtaatcataacttccttaaaatacaagagccgcaaaactttccgggatatctgtgctacttaatctggcagttcctactgtgtcttgcccccggtgtgacgtgctctcttccatgaaattaataactgcaaactgtaatgggaacaaggcaattgtctccgcactcttacccaaagcgttctctgagatgtttggtagttatttgggtccttacttgaccttcgtggccttaaaacaaagggaacatggcatttgtgaatctgaaagacttgtgataattttctcatttcctccaggctgtgtgcctcactctgagtttgcggagggatcagccctttttcagggcgccctcatgtcctgagtatcatcctcagaatgtgaggcttgggcccaatctgaagagggtgtgagggagagccaaaatgcagggattgtcccacaatgcagtcccgctctgtaaatcccttcctctgactagcttgatttcaggctctgagaatggatggggtgggatcgtgaaagggtggcctgtccctccacacctgtgggcgtttctcgtcgggtgggacgagagactgagaaaagagacagagacaaagtatagagaaagaaaagtgggcccaggggaccggtgttcagcttacggaggacccgcgcagcccgggtctctgagttccctcagtatttattgatcattatctctaccatctcggagagggggatgtggcaggacaacagggtagtggtggggaaagggtcagcaggaaaacatgtgaacaaatgtctctgtatcatatacaaggttaagaaaaaagtgctgtgctttgatgtgcacatacataaacatctcagtgcattaaagagcagtattgcaggcagcatgtctcacctccagccgtaaggcggttttctcctatctcagtagatagaatatacaatcgggttttacaccaagacattccattgcccagggaggagcaggagacagatgccttcctcttatctcaactgcaaagaggacttcctcttttactaatcctcctcagcacagaccctttacggctgtccggctgggggacggtcaggtctttcccttcccaccaggccatatttcagaatagtacatggggagaaatcttggacaatacctggctttcctaggcagaggtccctgcggccttccacagtgttttgtgtccctgggtacttgagattagggagtggtgatgagttttaacaagcatgctgccttcaagcatttgtttaacaaacacatcctgcatatccctaaatccattaaaccttgagtcgacacagcacatgtttctgcgagcacagggttgggggtagggttacagattaacagcatctcaaggcaaaagaatttttcttagtacagaacaaaatggagtctctttgtctacttcttccgacatagacacagtaacagtctgatctctctttcttttccccacagattgcttttcagtactttctgctgagacatttttgtatattcatttctctctcaaggagcctctataacaaaagagaaaaaagtatctcggtttctgtgtgtggcacatgagtttgaaggatttctgagactgtcgttcaggactggcgttacagattaaacgccaataagattcaggaccagggacgatgggatccctgacaggcggatataactcctcgttaaggacagactgcccaccactctccttctttctctgtttctgaatttattttctataaattccgctgggtatcagaaccttccttcggctgactgacgctttgcgatttcctctccaagcccggatctgttccccaaaagtctctcgttcctgcttctagcttctctttttagcttctctaggttcgcgtcatcggctttccttttttccgaggttgaatccccagttacaagaagccgagaggtcttcttgtcataaaattaacttccctcggctcctgtaacagggagtgggagcccaccctcccactcgccgtgtagcactctgcatctctgagaagaaagtgaccaccccagcccagcacagcacagattttctttgagcacctgctcggagttcctgtccctcgtcgctccttggttttccctcatcgactacatacagtctgttggatgtcggtcaaggtatcgccagcccctgccatgggaaccatttggggaaaaatagatccgatttattatacttcaaagatgcccaatgattccctgtcgtctgtgtaccataaaaataaaaacagataaaaataagatcaatgtattcgacatctacacccaggcgtacagctctgaggtgatcaactgggaagcgaaggtagcccacccagagggaagaaaggaacaaagctggagaatgcagacgtggatcctgcaggccgctgcctcccaagtgagcgggttacaaattccgctaaccccagccccccaccacgctattggctatttgaggcatgtggggtttttttccggactagaagtcttgtgttccacctggattttcgggaccactcaacattcctgagctccacccctgccaaggtggagccagcacaggactgcaggcggagtctccagactcatccagaaacagccactgcgcggagccgggagcgcgtgtcgaaagcgcacccctagacagctactgtgggaaagctctgggccggacacaattccacatgcttgatattttagaaaagaaggaattataccctagctgtaaagggagtgtggattacagctataacaagtaccaggaaggtaagctttccttgcaaaagctgccctctctgaggctcgaactcaggaccttcagattatgagactgacgcgctgcccgctgcgctaagagggcgacgaagtataatgccgcgccagcttccacaggaatttcctaatttctttccccaggtgggctattttgggacttcagttttcttcgcccagggtcgctagttctccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctttcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaatactctattaaatactttattcccataatttcatttagtcctatttatttatttatttatttatttgccataaatctatacatcattatccccatcttactgatgaaactgaggctcagcagaactaaatccacagctgataaggggtaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacttgccatgtacccgacatttatgttctagatttccaaggcatccttggccctttatccctcacatccctacaaacaccttaaatcattagttctcgaagtgcggtgcccagacccaccacataattctcgaggacacattccatttcaggtactgtcctacccgaaggctttgaggattcagaagaaattgagccatccctgacctcaggagctgacaggacaaactgtcctatctggtccagttcctatactctcaaacttccggattcttataaatgcattttcctaaatattttattttgatactgtaactcttccgctctgtactagtttgctagggctgccataataaatatcacagactgagtggcttaaccaacagaaaattttctcagttctggatgctagaagagttgttagctttggtttctcctgaggcctctctccttggctcgcagatggtcacttaccttcttgctgtattcttgcatggtctctctctctctacacatatttccatcttttcttataagaacgcctattgggatttagggtttcgacatgaatttggtaacgggtggggcaggacaaaattccaccgtaacaggctcaaagttgtttaaatttccaccttcagatttgcagtagactttgttactggaaagcactacttccttttttttttttttttaacaagtattttagagtcccttaattgaacagaccatatacctttccttacctaggaattcccactccaatgcgcggtccacacacccattatttctcctcatcttcattcttcaaggcccattcttgattctttcattcttatttgaaagaatgtagcatggaggaatgtagcatactagtttttccctcggaattgcatgactcattgtcagtaactatcttatggtttttgctgttatgacatttagtatggatgtgtgctatctttcattaatatcctccatcttgtagtcactgtttccataaggaagcgcagccagtg

SEQ ID NO: 180 - DNA, 44576 bp, Homo sapiens
ggttcttttaaaattcctttgatttttttttttttttttggcctgtttttcaagtgtccaatttttgtcacccttctcccatcaggtcagagagatagccaatggtcagaagcaatcttccagcaactgccatagcgctttctcctgcctgcagatgcctctttttagtcagcctttatgggaagtagcagcaccatccgttcccagagagcaagctctggagtagctgagctaaccccagttgctaatctgagctaatcccagttaccccagtggatttacagattgagggtagaacccagcagggttctcttcttggaaagaataggcttccctctaaggtttcacatagatactgggtgaggaaacagccctaaatggcttcagaaattgaatgttctttgggcaaagcaggaagccctgctgtggaagagcatcatttgagcataaatcaggttatcaggacaaacagagtgttcaggaggtctagatggttaagcagagagcctcatcagaatatccgtggtgaagagaaacaatcttgctgggagaaggataaccgtaactggggacttagaataaaggctaaaaatgattcaaagagaatgcaaaaagaatcaggcacaaatctttactatattctgttgtgcaaatctcaccttactatgtgtttatattctattcctccacaatctttattttatttttatgttcacagagacttgctggttccaactaaatgagcacaacagccagtgacaacagaactgcacttaaatagtccctcatcagctcttgagagcagattccttaaaggtgaacaatattccacatacaaggacttttcagcagtatgcattagaaatggaactgaatgtttattattctttatataagttggttgatacgacttttcagcttccctcagtaacattatctaaattttgtagatgacagtaaagctcagaggagttaaaccattttcctcaaatcacgtagctttaaacaggaaaaccagatatgaaaagcagatttctttctaaattaaaaaacaaaaacaaaaaaacttgagctcttgctttaccctagcacatagtctcgccatctgttttctccacaccaggtcattcatgtaacattcattcacataacaaatacaaataaatgagcggattcattcatcagatattaattcagaatctcttttgtgtctaccacactaggctcaagacgtcccagtgtctttgtctcctctccctcaaatctctccacccaatatcttgacaaataaagtagatccttcctgtacaacgtctccagaatcttttcttccttttctttcacctctgtcatcattcatgctacagtgtttacggaggatgtgttctgcagcatgaagtgtcgtgggcactagctctgcagaaagacttctgctgtccacctcaggtgctgacatgataaatgtgggtaaacctcaatcctttaatatctttatgacttctttccctttctccccagttcctgttttctcatgttcaagctctgacattcaaaactaaacacctttctctaacatgttgctttaattatttaagcattctgcctgggatattttcagttagtcatgggatttttcataaaactctcccaatatatctccaagtggccaggcttttcaatcactgcttccctccatgtgtatttcacacacacacacacacacacacacacacactctccacttaaattgaacaggtttatttctttacacaagaattcttacaaacagcccggttttctccaccatatgtccactccttctctgcatagctcaattttgattcttacactatattttacatattcttacactctgatacgatcttgtctcttattctttatggctctgctctgtaattttgttgttgttgttctgaaatatagttggacatgtaacttgtacatgacacaccttagcaaggaggcaactcatatctcagatgtaagtgaaagaagcactctccaggggtttcctatgggagtggtcagcacgctggcctcattggtggaatggcctagttacgaaaacagcaggagctttttgccttccagaaatctggaccatctcacaacccccagacagtctcagctacaaggaaaagtgataattccatcccacttttataaacacacacaaacacacacacacacacacacacacacacacacacacaatcatttaatcatttttaatcatttaatcatttttttaaaatctctgacactttagctgggcaggtctagacatgtcctcctttgctgggatgtgcctttttctgtcccggaataccctaaacttgacattttggcagcacgagttttccctttgtgactttctccttgttccctttctcctccttctttgcagagaatgagtagccactgcgccttgccctgggccatcagtgagaagacctgctcttagtagagccctgctttcccgctgaaggccttgaaatcccctgtgttccaggacacccactaaagatcaagaaagctcccctgacgtggggaattagctcaagcggtagagcgcttgcttagcatgcaagaggtagtgggatcgatgcccacattctccaagctttattatttggaccttgggtctccaaacactcaagtatccaaacccaagttagtgtctgagagcaggatgctgctttggttcaagacataggagcagcaacaatacaggcctggtgatggctccctcctggcattcagtatagtgtagatctactgtgtaattcatttgctgtttcctcaaggagctgtgaaaccaagggacatatacaactgctcttttctccctgtttctgcctgcagcttggtcctaaacctcagacaatcgtgaaatgtgcagggcagagccacctgggtaaacacagcctcggctttctgctcaggggactgaaaccaggatgtgtcaagtaactagaatgtgcctggacagatactgtagaaagcaaacccataaagttgttcatgagcttgtggacacacctgccagctgtgaataagtggctctaatcccaaacaacttacctacaaagagcctgagagctgaactgcgcaatggcccactttccagtcctcactgaagttgcacacactccggaaatctctgaacagtggcgtaaaggctttgcaaatagagttatctttgaaacaacaacacgtggaaggctggttggtacttggaacttgaatacaaggcaattttgtgcctgcaaaaacaaaaatagcaatattattcttaagatttcaacaaaacacagtgtctcatcacataatccaaagaagtccaggttacaagccccaaaatcttcggcattatgaaaaaaacagggagatcttcattcacatggcaaagagactcctcgaataacaatactgagaggacacagatgtcaaaatcatctgacgcatacagtggagcagttatgataacaatgctcctagaattaggggataacattcgtgaagtgaatggaaagttggaaagtctcagcaaatatctggaatatataaacaccaattttaagcttaagaatttaaaaaaatgtattaaccaaaactcttaggggaaataaaaagcttaactggatgatctcgataacagaatgcagatgactaagaaaaagtcaacgaacttgaaaacagaacaagaatacctacataatctgagctatagagagaaaggagtatttctgtaaatgaacagaggctcagggacaaattaaaaaatagcaaatctaacattcacattattgtaatctgaaaagaagaggacaaagaggtctttgtgggataaaactttgaagaattaatggctgaaaatgtatcaaatttgtcaaaagatataaaccaggtttttaaagttcagcaaaggtcaagcaggataaacccaaagaaacccaacccatttcaagacgtatcataatcaaactgctgaaaacgaggaaagtacaaaacaatcttgaaagcagtcaaaggaaaatgaaaaagaaactaccatatgaatgagtgtagatttctcatcaggaaccatagcggccagaaaaaaatgtcataatgttcagtaagtaacaaaagaaaaagacctatcaacccagaatgctatgtggagcaaaagtatctttcagacataaaggcaaataaatgcattctcattggaaggtaagtcaatacattctcattcttagcaagaatgctggaaaagaattagcaaagatttgagataagaaaagtgataccagaaggaaacttagaacatcgtcaatgaaggaacgaaagcagaaatagaaaatgtctgggtagacataacagactgttcttcttctcctgagttccttaaggtatgtttgatgattgaaagccaaaattgtaactttatcagaagcagttgtcattgtatcgagatgtactacatagataagataaaagggtaagtgtaatgggcctaactcttgatgaagtttctatattcaacttgaatggtaaaatattgattctaagtatactgtgaaaagttatatacgtatatggtaatccctagaccacttactaaccagattgaaataaaccaaaacaagatagacagaggaacatagaagaattaaaacaaagggaacaaaggttaatacattattaaatagatctatctaaaaacttatctatattaacattacacgtaaatgatctaaatccttaattaaaaactagagatcatcagaatgtattaaaagtaaatatgctgactgtaagaaagccacctgcaatacacttatatatcagaataaaagttatatagcagattgaaggaaaagagtgggaaagatacctcatgcaagcattaatcaaagacagctgtggtgtatacattaaaatcagacaaagtagatttgaaagcagagaaacttttcaggaataatgaaggctgctagataattacgaatgtccattctccagggaatactgttccaaatgtatatgaggacacagattttcaaaactcataaacaaaattagataagccaggtaaaaatagaaatatccaattttagttgaagacactaaaactcctctctcagtcattggtagacttagtagacaacaaatcagccaacatattggagaactgaaccacaccatccaccaatggatctgatcaacttcataacgcaaaataaaaatttagccagaaagcaaagacaaaaattaaaagaaaagtaagatcatgttataaccaggaaattaagagtggtccatcatatagaagggtgctattattgaaagagtttgaaatagtgacttagttattttgaaagagttttgaaggcattatttagctggaaatgacagaaagactgaaaatggtgaatctggaggtggatcttccctcatctatatttatcttgttttcttttgaggtctagggtgtctatacttcctctgaattacctgatcctactacagtgtctggcacagagcatctccccagtgaatatgtactaaatgagtggaaagtaattgatagattcaaaagagttgtgcaagaataatgttcattatttggcaaatcattgaatgtggtgtttgatggaagacaatgaatcaaagttgacttgaaaggtaagcccaaggccagacgtggtggctcatttctgtaatcccagcactttgggaggccgaggtgggcagatcccttgacgccaggagtttgagaccagcctgggcaacccagtgaaatcctgtctctacaaaaaaaaacaaaaattagccgggtgtggtggtatgcatctgtagttccagctactcaggaggctgaggtgggagcatcactggaacccgggaggcggaggttgcagtgaacagagatcacaccagtgccctggcagtaaagtgacaccttgtcttaaaatgaaatgaaatgaaatgaaataaaataaaataaaataaataaaataaaataaaataaaataaaataaaatataaaagttaagcccaggccgggcgcagtggctcgcacctgtaatcccagcactttgggagaccaaggcaggcagatcacctgaggtcaggagtttgagaccagcctggccaacatggtggaaccccgtctctactaaaaattcaaaaactagcggggcacctgtagtcctagctactcgggaggctgaggcagaagaatcacttgaacccaggaggcagaggttgcagtgagccaagattgtgccactacactgcagcctgggcaacagagtgagactccaactcaaaaaaatttttaaaaaaaatttttaaaaagttaagcccaaaaggtaagtaaagaggaggtctggaattagatatttggtgtatgagtgaatgagctaaagtgcaaaagaatgggcagaataaccgtgagctggagcagagggaaaaaaatcacatgcaaaatctaaaaatatctgcttctcaattcgggctttcccacttagcagctttggcatttaaaaaaaaaaaaaaaaaaaaaaaaacacttgaccgggcacggtggctcacgcctgtaatcccagcactttgggaggccgaggcgggcggatcaggaggtcaagagatagagaccattctggctaacacggtgaaaccctgtctctactgaaaaaatacaaaaaaattagccgggcatggtggcgggtgcctgtagtcccagctactcgggaggctgaggcaggagaatggcctgaacctgggaggcggagcttgcagtgagcccagatcgggccactgcactccagcctgggagacagagcgagactccgtctcacagaacaaacaaacaacaaacaacaacaacaaaaacgcacttagcctatctgattctctattacttctaaaaagtgcatactaaggcataattttgttggcaaaagtcaatcagactacatcaagtaaactccctaagtctcctagtataattcacggcacaaaaatatgaggaaaaacagggaggatatgattaaaagtttagtttgtattttttgttgagtgaatgtctccagtcatagagatgcaagtgtagatacacagtaagagtagtatgaatggcagacaccttggaaggctatttcttccttcattcattcagttggtcactcaatgaactatcatgaattgagcactacctctgtttcttatcaacaaaggagactacggaaaggaagaatgactaagatctctgaagaagggaaaagctagatgactgggccacaagaggaaaaaaagcagcaagacaggtacaattgtgtctagtccctcaagccagaaggtcctatcattatgtgaatactggaaacgggtggactccacctgtcctgagtggggaattcttccagtgcagcattgactgataaggagtgatttccaagtagcattgattgtgttctttaaaagctaggaattgataaagcagcagtgcgtgggaaatgagatttaataatctggatgtcacctcttaggaacagttgctctcttagagcagcaggccacctgtcaatctcgtattctgaaggtcctgagtttgaacatgagacaaggcacagcttatgccgctatttccattaagagaaatgaaataggtgtgataaataatggaacacaaatgctatgagataatgatttcaagacagaccaaatattagcttaaaatttaaaagtgagttttcttttcttttctttctttctttttctctttctttctttctttctttctttctttctttctttctttctttctttctttcttccttgcttccttccttccttctttccttccttccttccttccttctttcctttcctttctctgtctgtctttatttattttttccttcttttggcttctcagtcgcttgagtacaaggcgtggtgaaggcatataaattacaccagaaactgcaagctatgtcttatgtctacctctctagctgacaggggaggcaggggaaatttctcttccaattgcctgctctgaaggtcatccaaacataattatggggtggggtgggtaaagtcttttattcttttaatcgtccaaccgatagttctcaacacatatcttgttaagagactgttttgggtatagcaattcgcagtgaataaaatacagatattctcacctttgtgatactacgtcaatgttggggggagtggggagaaagagacagaagcaaaaaagaaaaataaacaagaagtcatgtgatattatctactgggagggagtcattaggcagtaaaggactcggcagtgtggaggtgacacattcacttttcaggagaagaatcagggaagttgtcaccttgaagatatcatttagcttccctttcttccaatagtctttctttacatgggaaatgaggactctaggattctccggctggatctcagcacctagagatggatctgggcaataggaactgctcagtaagcattacctactgctttggttgccttctccctggcctcttggattgagcttgcatcatacgtgttcagtaggaacttgcttagtggatttacaggttgaggttagaactcaccgggattctcttcctggagagaacaggcttccctctaaggtttcatatagaccccgggtgaggaaagagccctaaatggcttgaaaaattgaatgctctttgggcaaagcaagaagcgccactatggaagggcatcatttgggcctatatcagggtctcagtacaaagatgagtgctcacgtggtcaagatggttaagcagagaatctgaccagaatgttcacggtgcaaagaaataatcttgttgggagaaggatcacaacaattggggaattagaatacaggctaaatgagactcaaaaataatacaacaagaatcaggcacaaatcctttactactacattcttttgtacaaatccattttgcctagaaaatcataccttactatgcatccctattgtgtttctccaccatctattttactttttaaactttatttcatttttatcatcacagaagcttattgctacaaaacaaatgagcaaatcagccaatggcaacaaaactgcactgatctctctccttagaccttcagaacattttccttaaaggtgaacaatactccacgttcaagaatttttcagctctatgtgctagaaactatactgactgtttattaatttttatgtaagttggtcgatatagtttttcagcttccccaagtattattaccctagtgttacagatgacactgaagctcagagcagttaaaccattttccttagatcacataactttaaagagggaaaccagatatgagaagcagatttctttctcaatgaaaaaaatcacaagctcttcttgctttagtctagcacatagtcttatcatctattttcttcacaccagctcactcatgtaacattcattcatttaccaaatacagataaatgagtggatttattcttgcatcgatcagatatgaattcaaaatctcttctgtgtctgccacaccgggctcaagacttgccagtgcctttgtctcctctccctcaaatctctccacccaatgtcttgacaaatactgtagatccttcctgcataaactctgcagaatctttttcttctgttttactcacctccttctttatccatgctatgatgttcatggaggatgttttcttcaccatgaagtgtgaaggggattgaagctgcagaaagactcatgctgttcacctcaggaactgacacagtcaatgtggataaatctcaatcctttaatatctttatgacttctttctctttctccccagatccagtttttccattttcaagttctttgacatttaaaactaaaaacctttccctaaaatgctgcttttctacctggaattttttcaatgagtctttagcttttataatattctcccaacatatctccaagcatccaggcttttcaatcactacttccctccgtgtatattttacacacacacacacacacacacacacacacacactccacttaaattgaacaggcatatttctttacacaggaattcctacaaacattccaccctatacctaccctaggttttctccaccctatgtccactctttctctgcattgctgaatgtgttttctttattctttcactctgatatgatctttgtctcttattctttatgcctcttatctgcatttttttgttattattgttctgccatgcagttggatatgtaacttttacatgacacaccttagcaagaagacaacacatgtctcagatgtaagtaagaaaaacactctccagggatttcctggtgtagtgctcagcaccctggcctcattcctgaaagtccctcggtgtggaaaaagcaggagctctttgccttccagaaatctgcatcatcccacagcctcagctacaagaaacaagtgacaatgccatctcttttcttttaaaaaaatcatttaagcttcctgagatatctgtgacacattagctgggcagggtccttctgtgggacatgtcattttccgtctcggaatatgtgaaacttgacattttggcaacaccagagttttccctttgtgactttctccttgttcccttttctcctccctcctcacagagaataagtacccactgcactcttgccctgggccatcaatgagaagatctgctcttagtggagccctgctttcgcggtgaaggccttgaagtcgcgtgtgttctagactgcccactaaggatgaaaaaagatgctgtgagatgaagaagtagctcaagtggtggagtgctcgcttagcatgtgagaggtagtgggattgatgcccacattctccaggtttcactagtcggacctcaggtctccaggttacagtggaaaaaaatatgtgttagacactgatctcagaaaacagtaagttagacactcatctcagtagcagcctggacacttctttggctcattatgtaagggcagcaacaatacgggcttgactaagattctactggtatgtggtatagtatagatctatcgatgtgtaattagttttctgtttctttgaggagctgtgatacaaagggacatatccagttgcacttattctccctgtttcctcctgcagcttggtcctaaatgcagcataattatggaaagcgcagggcagagccactcaggtaaatacagccccagctttctgatcgggagaccgaaactaggagttgccaagtaaccaggaaagacactgtggagagcaaacctgtcaagttgtatgtgaactcctggatgcgcctgtgagctgtgaataagtggctctgatcaaagacaacttatctaaaaagagcctgagaatcgaactaagtgatagcctactttccagtcctcactggccactgggttgcacatactccagagtctctgaatagcagtgttaaggctttgaaaatagaatcgactttgaaactacaacacacaaggctggctggttattggaacttgaacacaaggcaatcacatgcctgcaaaaacaaaaatagcaatattatccttaagatttcaacaagacacagtgtctcatcacataatgcaaagtacaaccccaaaatattcagcatatgaagaaccagggcaatcttaattcacttggcaaagagaatcctcgaataacaatactgagaagacacagatgttacaatcatctgacacatacttttaagcagttattacaacaatgctccatgaatgaaaggataacactcttgaagtgaatggaaagttgggaagtcttagcaagtatctggaagctctaaacactgattttaaacttaaaaattaaaaaatgtattcatcaaaactattaggagaaaaaaaacttcaatgggttatttcaataacaaaattgagacactcagaataaagtcaatgaacttgaaaacagaacaaaaataccaacctaacctgaacaatagagaaaaaggagtgcttttgcaaatgaacagagcctcccggacaaacagaaaaataagaaaaatctaacacatcattgtaatcctgcaggaagaagagaaagaggtcctccagaaagaaaactccgaagaattaatggctgaaaacatatcaaatttatcaaaacactttagaagttcaataaatgtcaagtaggttaaacccaaagaaatccatacccagacacatcataatcaaactgctgaaaactaaggaaaaccataaaaatcttgaaggcagccaaatgaaaataaaagggaaactgccacttgaatgactgtggacttctcatcagaaaccataggggcccaaggaaacatttactaaataccaaaagaaaagacctgtcaacccagaatgctatgtagagcaaaaatatctttcagactaaaggtaaataaatacattctcacaggaaggtaaactgagagaattcattgctggtagaactgctggacaagaattagcaacgatttaagatgagaaaaatgataccagaaagagacaggacaccatcagtgaaggaacgaaagccgaaatagaaaatgtctgggtagacattacagactattattcttctcttgagttccttaaggtatgtttcatgattgaaagcaaaaattgtaactttatctgatgcagttgccattgtatctagatgtgctacatacataacataaaagggtaaaggtaaagggcctaactgctgatgaagtttctatattcaacttgaatggtaaaatattgattctacgtatactgtgaaaggttatatatgtatatggtgatccctagaccacttaggaaccagatttaaataaaccaaaataaactaggaagaagaacatagaagaattaagacaaggggaacaaatgattaataaattattaaaaagtagatctatcggctgggcacggcgtctcacgcctgtaatcccagcactttgggaggccgaggtggctggatcacctgatgtcaggagtttgagaccagcctggccagcatggtgaaaccctgtctctactaaaaatacaaaaaattagccaggcatgaagccgggtgcctgtaatcccagctacttgggaggctgagacaggagaatcacttgaacctgggaggcagaggttgcagtgaggggagattgcaccatggcactccagcctgggtggcaagagcaagactccatctcagaaagaaaaacaatagatctacctaaaaacttatctataaaaacattaaatgtaaatgatctaaaacaatgaattgaaaaccagaaattgtcagaatgtattataaatgaatatgctgactacaggaaagtcactagtaatatacttatatgtgagattaaaagttatatagcatattgaaagtaaagaatgggaaaagatatgtcatttaggcattactcaaagaaagctgtggtggatatattcaaatcagacaaaccagattttaaattgtagaaaacttccagggataaagggggctgttacataattagaggtgccaacacaccagagaaataatgtcccaaatgcatataaggacacagggcttcaaaactcgtaagcaaaattggataatccagataaaaatagaaaaatccaattacatttgcagacgttaacagtcccctctcagtaactgatagatccagtagacaataaatcagtaaacacatttgagacccgaacaacatccatacagcaatggatctaatcaatcaactttctacagcaaaatcacaatttgggtagaaagaagagaaaaaaaataaaagaaaaacaagatcatgctataactaggaaatcaggaatgttcagggtgcaaaagagtgatatattgaaactgacatttttgaaagggttatttagctgtaaatgacatgacacggagactgaaatcgtaaaactggacgtggatcttcccttctccatatttgtcctgccttctcttgaggtctgggctgcttgaatctttagaatctcctgaacttaccacagtgtctggcacagagcatcttccctgtgaatgtgtactgaatcaatggaaaggaattgacaggttcaaaaatgttgtgcaggaataatgtttactatttcacaaatcactggatgtggtgtttgaaggagaaaaatgtgtcaaaagttgacttggaaacaaagcccaaaaggtaagtgaaggggatttggggaatgagatatttggtgtgtgaatgaatggggtgctgtggagaggagtagggagtaagattgtgaactggagcagagaaagaatcacgttttaaaatctaaaacatcttctcctcagttcaagctttgacacttagcagctctggcaccttggaaacaaaacttatctgaggttccattacttctagaaagtccagattaggacacatagttttgttggtgaaactctgttggactacatgaagtaaattcaataaatctcttagtataattaatggcatacaagatttgctttacactttttgtagcaggattgtctccagtcgtgtagatgcaagaggagatagagagtaagacacagtagtatggacaggagacacctttaaagactattttttcattccttcattcgttcagttggtcagtcagtgaactattatggactgaacatgtcctgtgtgtcttttcaaaaaaggacaccataggaggtgtaagagtgattaagatctctgaaggagggagaagtcagatcactgggccacaagagggaaaaagtcagcaaaacaggtacaattgttcttggcctcttgcctcaagatggtcgtcttgttagatgaatactagaaatgggtagattccacctgtcctgaggataaaattctttgggtgcaggattggctgataaagagtgatttccaagcaccattgattgtgttctttgaaagttaggaactgataaagcagcagtgcttgggaaaatagcacgtgggatgtcaattcttgggtgagaaccgccctctttctgcagcaggccacacatcaatctcataatctaaaggttttgagtttgaacatcagagaggatacagtttttgctgctatttcagttgagggaaacaaaatgggtgcactaaataatgaaatgcaaatgctatgagataacagtttgaagactgactcaacattagcttagaatggaaaagtgatttcggttttttggagtttttttgttgttgtttgtttgttttttggcttgtcagtggtttgagtaaaatgagtggtaaagggatatagattacagaagaaactgcaagctatatcatataattggtctttctcactagctgatggaagaaacaggaaattttttgtcgagctttctgctctcaaggttacccaattgtaattatgaggtgagtgggtgaagtcatttattcttttatcctacatgtatttctcgagcacgtatcttgttaagagactgttcggggtacagccattcaacagtgaaaaaacgcatatattcttcacctttgcgaagctagtttctagttgataggggtgaagagaaacagatcagaagcaaacaagaaaaatacataagatgttatgtgacaacgtctactgggaaggaacccacaggcagtaagggacttgggagtgtggagatggcccattcagaagcttttaggagcggaatctgagaagttgtcaccttgaagacatcctttacccaccctccaccccctccccactccccactcctgctccttccttcaatcatctttcttcacgtaggaaatgaggactgtgggattctctggctggatcccagcacctagagagggatctgatcaataagaactgctcagtaagcattacctattgctttggttgccttccccttgcagagtgctggcctcttggattgagcttgcatcataggtgttcagtaggagcttgcttagtggatttacaggttgaggttagaacccaccgggattctcttcctggaaagaacaggcttccctctaaggtttcacatagaccccgagtgaggaaagagccctaaattgcttgaaaaattgattgctctttgggcaaaacaagaaaccctcctatggaagggcatcatttgggcatatatcggggtctcagtacaaagatgagtgctcaagaggtcaagatgcttaagcagagaatttcaccagaatgttcgtggtacagagaaacagtcttgttgggagaaggatgacaattgaggccttggaatataagctaaataagcttcaaaggggatacaaaaaagaatcaggcacaaatcctttactacattattttgtacagctcaatttttgcctagaaaatcataccttactttgcatccctattgtgttcctccaccatctattttgtttttttaagcgttatttcatttttatgttcacagaagcttgttgctacaactaaatgagcaaaacagccagtagcaacagaaatgcgttactatctctcctcagaccttgaaagcattttccttaaaggtgaacaatattccacatacaaggaggttttcagcactatgtgctagaaattatactgaatgtttcttaatttttacgtaagtcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacattaatgtaatagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctggggggcatatagagccactcagagccttagaggtacgttcagtgaaatggagccaatcaccatatagtgtagcctattgttcgtctgaccaaaatgcactatgttgcgatagcatggattctacagacccgtgaagcccatttggaccacaagacactctttccatcatgcctgcacacctatccttcactcttcattggctcatgcagacttttgaaagtatttagcaataagcatcctacccccaagaagcttatggtctcatggagaagatggccaagcaacagacaatcccaacatggtgaatgccgctaaaacaaatgcgtacctggatctccgtgagtgctaggaggaaagcaacccaaactcagaaaagtaggagaggtgtcagggaagacattttccagaagatggtttcgtgtctaacaaagccgtgagacgagcaaagaggaggtgaaaggctcagcgttctatggggacatttccttaagtccagtatctctagagttgagtgagggaagctaaaagagaggaaatagaaatgaaaaatgggagttcttgagaggctttacttaccctgcacaagccaaggacaggtctgcgggaagtaagcagatgcacagttaggaaagcccatatcaggagttagtcacgacagagaaagatttgtacactttggaaatcgtaaaagaatgaaaagcccaggtccttatttccctgttttcgtctctgtttttcacgttcctcccggatttcaatttctttctggaatcttagctctcttcgtcatctgctcttgcaggaacactgaactgcaaacgcaaccctacgattcagcgaactacgtcctatcaaggttactgggtacaaatacatttactttcgtgagttctcttgtgactttctgtatcactgcccacagttgctactgtgagacaagcattagaagtctgtgtagattgctgggttcacacacatttacattctttttctcttgtgagctttgacgtggctacacataattgttactgtgaaataaacattagaaaagcctgtggcccgtgaaataaacattagaaaagcctgtggcccgtacggggatcgaacccgcgaccttggcgttattagcaccacgctctgaccaactgagctaaccggccccgccggcggaacggaccctacctctcttgagaagtttaaaggcgaacgttattccaatcaccaaagaaacttttctgaagttcttggagttggaaagaacctacgatctttgctaacttggttacgatcctcggcaaatttcttctaacctggaaatttcagttaaaatacaattctgcggaaggaaagttcaaatgtcacctgcttcagtgtttcacgacaaagggtttcagtgaccacccttttaaacgcaacgccatcaccgtccgccggtactgtggcctgtccctatcactcctttctactttgcttccgtagcttctgagcgacccgtgaagaaattgacggaaaacggaaggaattgccgccagttcctttccacgggccgtcaaggccagtataagtccccacccaggctcctctgctcgtaacttctagcacgattcccactgaattcgcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacatttcgaataactgaataaaggaaatctcaaccaacccccttgccgtattacaggtggtccagctctctgcctagactattgtgctaatgtcctgttccttctcccggcttttgaactagattctcacctctctccaatccatctttcgcagggctggcctgtctttccgcctcacttctgaaattctatccattgcagcctctatgcaaaccgactctggttaatacttcagtcggtatggctcccctcttccgcactttgcactgcgagaaatgcccttccttgaggcagctggaggcctcctcctcctgagagcttaattgtggacacagtcttgagtagaggcgaaaaggaaagaaggctgggagataatgggggaaaagcacacctttggtctggtttgaaagctggcgcccgaaaaggggagcgaaaggacaagaaaaaaaaacacgctccgaaagtgtctgagattgctgcggccataaagcagagcactaaccgcggtactgataagggaggggagcagggctccgccgccgggcctgtgcccatggatctaggtgaggacgggcactccttcctccgcggccaaatgttgcatttcccaagaccaccctggcccgccacgcccccatcctgtgcctataaaaactcccgagaccctagcgggcacggacacaagcggctggacgtgaagaggaacacaccggcgggagaacacagaacacccaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgagctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaaaaacaaaaaaaaacaagtgttctagatttgcagaggaccttttcggagctaagttccagtagctatactgtaagttgatttcttgggcagttctgttggtgaggaaagagggcaaattgagaaatgaacaaacacagaagttgcaaaagccctgtgacttacagcacaggacgagtctacaaaccctgccataccacactaagctcaaattgttttaacaccagcttactcagacccgatgatccaagataagaccaaagccaaacggatccagcaactctgcgcagatcttcatgttccagcagctaagttccactgaataaacctatgattcgcctagtttagaaattctggccgtgcgcggtggctcacgtctgtaatcccagcactttcggaggccgaggcgggcggatcacaaggtcaggagaccgagaccatcctggctaacacggtgaaactccgtctctactaaagatacaaaaaaaattagccgggcgtggtggcgggcgcctgtagtcccagctactcgggaggctgaggcaggagaatggcgtgaactcgggaggcggagcttgcagtgagccgagatcgcgccactgcactctagccgggacgacagagcaagactccgtctcaaaaaaaaaaaaaaaaaaaaaaaaagaaaagaaaagaaaagaaaagaaaaagaaaaagaaattctgtccagtccctcctgagaaggaccttactaaccttccccctaaaagtgtcctatgaatagctccagtccccagaccctttaaattctggtctctgactcacccttgttttaggcagtactgggactccatagaggtacggctctttgctcagcaagtttaataaatccaaggtagtagaatcaatttgttttcttggtcgtcttgtttggagggagtgggtcttctcaatgttggttctgatccctgcctatggatatttatgaataaatagatatttgcactccatcatcatgtggagctacaagtgttaaatttaacgatctaattacctctaaaataaccactaaattcaacaatctgaaacttatctaattagttccacatcctggaatgaagggatttaataggtaataacaggtctcagtctctaatggagacataatcacacagacaccagatgaaagatgagtaaagtggaaagcaataggtagaacaataatttgctttatgctatgatttttggagcgaagcaagaaaattaatcaaggaaacaaagaagaaatccaagacttagtagtgttggatttgcatttttgtcatatgacactacttgtattttacaggattcacttggtctccatctgacctcctcagagtagactgctctttcccaatcactcctgcaattaccctaggagatgtgtgatcctaaagtaagggggagttttaaatttacttctaagtacacctgcatgatgccattagtcagggcagggtagctgaacaaactcagctctgaatcctttaagcagaggtaataattgctgacactatttaatcggattctgaacatgatgtgccacttttccttttgcgtctgaagtgacaccagccattttcacagtttcttccactaggaggtcctgggagaaaagtgataaaggtagattcaagaatggttagtttgataagagaaatataaaggcaagtatctttttcactcagttcaccttggttctaagagtgggtctatataaagaaatggagcatgcttctgctaattaatgttcaggcagaaaaagtcatgaattccactacaaacccatgtcccttcttccgaagacatgacaaattgatgagggtatgctttcttctgtcggtaaaacgaagtctgggatatagattgcaatattagcagtgccatagtgcagaatttctcataattaacacttttcacttgaatacataagaaaatagaattggaatgtaaagttaataaattaatcatgttataaacaatatgaacataaaagcaaaaattgcaaggtctttggcatgcagtctttgatttggggaatgcattttttctattgttatcaggaagaaagaacagaaacagttcatattcacatggactagacaaaagtatgcatttatgttcttactccagaggtatatcaagtcccccaatttttcctaatctagtccaaagagaattgaactgtctgcaccaacagcaaaacattggtacactgtattgatagtatcatttaaatcttcgatgagcaagaagtgtcaagtaagttgcagattttgttaagccctgcatgctccagagggtgggagagaaacacagaaaccattcatcgacctggttcgtgaatgaaagtttttaggatctgtgaaattctgagacatttcctccaaagtaaagtctcattgttgtatctcgaagctcccgtcacttagaagggagcactgtgctcaccatgtttctctgagctgtgaaagcggcgcgttccacacttggagacccttctctgacacatttaccaacagatactgaattaaaatattaacaaattgaatccagcattatctgtaaagcataatgcaccatgagttaggggagattgcctcgggaataaaaaattagttaggcattgaaaagtcaattaaatgtaatataccacattaacaaaacaaaaaatacatgtaatcatctcactagatgcagaagaaatattggaccaaatttgccattcattcgtggtgtttaaaaaatatcccagtaagctaagaatagaaggaaaattcctcagatgaataatgggcgtttaagaaagtcctacaactagcaatagagttaatagtggaagaataaatatgtaccctttaatattggagaaaagtgcaaaatatctgtccttactacttctacattttactgaaagtcctagctagtgtcagaaagtaaggaacgcatgaatgaagaataaatggcatactcactttagaataagaaaaatatattcgtttgcaagcaacatgatcagatacacaaaaaatcctaatgcatctacaaaaataagcattataagtaaatgcagctatgtcacagattacaatatacaaaaattaattgtatttctatgtactagcatcaaaaaaatggaaaattaaattaccactttcaataggtttaaaacaaatgaaatatttagagataaacttgtcaatgtgcacaagacttgtacctagaaatctactaaagattgctgagaaaaactcaggaaaacctgaataattggtggtgtttgccatatttacagattgagaaatttaatattatttagataactttttttttctctgagttgatctatagatttagtacaatcccaacaaatatcccagcaggagtttttgttttgttttgtttgtttgtttttacagaaattgacaagcttattctgaaggacttagagtaacctaaataattaggaaaagaaaaacaaagttagaggacttacaccaagtaatttcaagacttactataaagctaaggtaatcaaaataatgtggtattgtctcaaggatacttacccagattgatggaatagaatagatagtccagaaatagaccaatgtatgtggtcaactgatttatgacagaggtaaaatgtttttttaaacaaatggtcccaggcaactgagtatggaaaaaatgattccctacccttaactcacatcctgtacaacagttaaatcaaaatagtttatatacaaaaagcttaacgttaaagatatcaaacttgtagaagaaaagaagaaaagaagtctacacatatttgatgtaggcaaagctttttcagaagggaccagaaaagcatgagcccttacaaaaaaagatacactggattttataaaatatcaaaatgtttttatttgaaagacaatattaagaaaatgaaaaggcaagacatagacttgaaaagaaatgtaatatatgttatatgcacacatagttgttatacaacatatgtgttatggatacacatataacaaaggacttttatggagaatatagaacacattttagaactcagtgatacaaacactcagtaaggataagggcaaaaaacttgagcaggcatttcacaaaataagatgcttatatggccaataaggcacactaaaagatgttcaacaacattaatcagtacaaaaatgcaaattaaatctatcaaggattaataggtaacaacagatctcaactcccctgaatggagaaacaattagtaacacagatactagataagttacttgaaggatcaatcgataaaaagatacttgggcttatttccaggtttgtgttcttaaaaagtgatgcattcaacagagcatttgaggtaactgctaattagggacggtacttccttctctttcatctaatgggagagtgaaatcagattagaactagtgctttcctaatgagatcttttctctctttctcaggatcccgactcagattgaaaaagcagaggatggtcactgccttccaggtctgaggctgtctcccagaaacttcattcctcgcttcgccttggtagggaagttcccggaggtgtttgaaaagctggaaacttaagtgggacatggaacgatatttgtgtcccggttatcaaaacaggcagaaaagacaaatgcggtgtgggggaattggctcaagcggtagagcgcttgcttagcatgcaagaggtagcaggatcgacgcctgcactctccagcttcttttaatccctaggctaccaatggtatctggtaaatactttcagcggatttaccgctctttatttgactcagtttcatcttgttatgtacattttttttttaaggaaattatacatagcattccatgcaaaagcaaaaaaggaagcgattagtcacaagtgagttttgccaatacaggttttggggcttcagctcgaagttaatacaatgtatttttgtggggaaatcaaactttagccttttgggtacaaaatatgaggaacagcctggaaatagtgtcaggaggcaaaagcaggagacttgaatgtgccaaccttttgcttttattcacattgacaacacatggtcaggtagaggatgaaaacgtgtcttctaccagattatctgagagttggccaggctcccaccttcacttatactccttccttacctctctcctgtgtaggtaagagaggtaaggagagaggtaaggaaggagtataagtgaaggtgggagctagcatattaactctagtggtcggatacactctcactaagaaaagtgacatttattccttctattcatctctctgaaagctcgttctgacaaaaatgtgctcaaaataaatggggacctaggtcttcctctaatttccaagatgaaccaaaacgtaaaaaaatgtatttttgaaattgcaacactatcccctatttaaagaaactacatgaggcgctgtattaacaacacatatgttgactagctcaactggcccaagcagagctcagaatgctggagagagtggtctttggatagatgactccaggaagctcttgtaggtccctgggacgtgcccctctttccatccttctttctttcccatcactcaaatctctctctgacaccatttgacttctcagcattgccctttgttaatcgtaatagaaagacaatgttattgattacatgtttttctattttatcttcttattcataaatgatctcaaaaatgaatgtcataaataataaacatgttgttgaatttttgtcccataggagcagcctctttccttctcaggatgtgcactcctaataaactgggaccgtgaaggagggacctgaagctgccccaaaccacctgcagttccatgaaggccatgcctccacccactaatcactctgaaagtagtgcccctccactcttccccaaccacatttccttttcaggcaaaaacatttctatgggtttgttagaccctagcttctaatcctttcttcagtctttactgatctgaagccactctctcctttgaggcttctaaattatctgtatagcctttctccattcagcaaattttcatcaggcaaaaatcctacttgacgctagttatactcagagtaaaataactatgttcctgtcttaaatgagaattcttcacaggtggaaagcagatttggaatccactacaactccaaggcagtggagctaatgtagcctcccctgggctacaggggaagccttcttctgtgggcccgggaattgaagaactagacaggcataagaaggacaagtgtggtgcccaatggagcaagagaaggggggaggaaggtgacagggaagggaaatggcaggagaagcacctacacagcagacacggtatagcctgcatctgtttttccttttggctgagagatccctgagctctgtggtgacaattttccataatttttcatataaaaaatgaagattataaactatttctaggcattttacctgcattactattaatatgtgtacagcatctaaaatagggtctagacggcaattgcacagtactattacttgctattgttgtggcactttctatgtggatcactggcctcatccactgtgcctggtgctgaagaagtgcttcaggaatgaatccacagattgagatgaaaattctcaagctttctctttctcaactcctccaaggttctccatcactttctgagtcctacaggaggaaagtgctattgaagatgcggcgcgtatggcgtgaagttctggggctgggagaagctgccccactacttccgggcggccttgcctgcagggagcaggtgaggatcacagctctagagcgggctgcaatagctgtgcccgcaagccaggcagttccgggtggtgcttctccaactggaacgtgctctctacttccgagagatgaagaaggcgaaattgagaagtgaggagagaggtctccctcatgacctattttggaaatccgtattcttcacactctcaggctcgtagaactttgcccaaggcagtatctgagaagctccgccctcaatcttgtcctgccagggatttggcggcccaaagtaccggcaggctcctgataaccaggaaaatgggtggggggtggtgtatcctcagtggggaattagctcaggcggtagagcgctcgcttagcatgcgagaggtagcgggatcgacgcccgcattctccagttccttgtccggtttatgtctcttggtttgtatacccgcttctttctcctgttgacaacggcggtgcttcttacctgggagaagatcagaggaacctgccccctcccccgatctcgtgttttactgctccccatgtaagagtcttgttgcccctgcttccatcctcccatgttttccactcctgccacaggtttggcacttctagctactcaggtctcaatgcaaatttcccgtctttagacaagtacagctaaaagtgatgcccacacgatctctcaattcctactacatcttcacaaatatcgtctcctccagaaagtatgtctttaagttactggtttgtttttctctcccctagagtgggagcttcctgagtaccgaaacgctgtctatgtacactgtgttcaactcgcttcatccccatgcgtagagttaaggttctgtaaaatacggttactgccttgaacagataaggaaacagggagatcaaagacagagcaatacttaaaaacattatcctgccacatttctcaaatcttaataatagcattcactaatgtttttggtttttctttgtgctttctccatatccccttattattattattattttacatttggctgaccattttacacttctttttcaaatgaccaatcagattttgcaattttctagttaattcctgtgtttccttcaccattctattttctttttttttttctttttctttttttttttcgggcttcttcttcttcttcttcttcttcttcttcttcttcttcttcttcttcttcttcttcttccttcttatatttaatgcactgatttcttctaatgttttgtaacttgggtattaaaaggtgtaatttaaaatgagaaagcagtttctacagagtccttagaaatatgtcattttaagtccccattttcattatattctaaggagctcgaagatatacttttgattcttttctaaactgtgcattcgagagttaatctcttcttgtttacttttacgttcattctttcaatgttattttctaatttttgtgtatcattttgtttatcaacacataaatatgtacattcacataagtatacgagttatatatacatgtatttatgaatggcagctgaaccacacattagtgctaatattggtgactaaaagttggagaaccagacattatgtacctcataaagcgaagcaatggaaagtgcacaagcccacctatcaaattgtcttgttaaaagatttgaagctgaatctaagtgagcctctacttgtaactaccagtttacaagaaatagagtaggtgaagaaacatgtcaaggggcaggaaatagatacaatgaaataaatacaacatagaggtgtttctaaggataaaaggcccagttccttcaacaactaactggcattaactctttatgatactataatggtaaatatatgtcattatacatttgttaaaaaaaaaaaaacccaggatgtataacacaaagagcaaactgtaatgtaaactgtggacttcagttaacaataatgtattagtaattactggtttaccagttgtaacaagtgtaccatactgatgcaagatgttaataatagggaaaattgtaagagaggtagagtgatggagtttatggaaattctatctattctggtcaatttttctttaaacccagaacttctctaaaaaataatgtctatcaattttaaaaaataatatccataaaagaaagaccagggaccttttatggatgaaaagagtcttaaaaaacataaaaatctgtagattttactttattatttataatcagccattaagagaaattttttttgtatgggtgacaatcagaaaaaaaagttaatattagatcatatttatgatctattaccaatttgttaacaacaagtacatacacacatgcaaacatggccctaaaatttcctagttctctcaagctattgatttcatcattctctctgctgctgagttcaagaaagtgaaatgcgtaatgggtatctctcctttcccaccttccttccagttcacaacctagtgctgtccacttgcatgggatgtttcttttccatcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtagcatcaaaaattaaagctaaatgttgatttctttctggtaattattttgttcagcaacctggaaaaacgaacaaaaattatctcattccctttcctatttaaagcctgaaatatttaattaaaatgataaaacttaaaaaaagtgcttattaggccaggctcggtgggaggccgaggcgggggcggggcgaatcactggaggccaggagtttgagaccagcctggccaacatggcgaaaccccgtctctactaaaaatacaaaattagctggacgtggtagcgcacgcctgtaatcccagctactcgggaggctgaggcaggagaatcgcttgaacctggaaggtggaggttacagtggatcgacatcgcaccactgcactctcaaaaaaaaaaaaaaaaaaaaaaaaagtctttattgaaagtttcaaacttaaaagtgctctcacatataaataaaatcattttctctatatacatggtttttgcaagtgtacatgtctagacaccctaggaatggtggtgccgtggtgtgaacgtggagcctggaatggccagccccaaaacctcctcctcatcaactgttgactcgtcaacagtcagtcagtaatcaaaacttccttaaaatacaaagagccgcagaacattccgggatatctgtgctacttaatctggcagttcctactgtgtcttgcccccggtgtgacgtgctctcttccatgaaattaataactgcaaactgtaatgggaacaatgcaattgattgtctccgcactcttgcccaaagcgttctctgagatgtttggtagttatttgggtccttacttgaccttcgtggccttaaaacaaagggaacatggcatttgtgaatctgaaagaattgtgataattttctcatttcctcctggctgtgtgcatcaccctgagtttgcggagggatcagccctttttcagagccccctcacgtcctgagtatcatcctcagaatgtggggcttgggctcaatttgaagagggtgtgagggagagccaaaatgcagggattgtcccacagtgcagtcctgctttgtaaaccccttcctctgactagcttgattttagtctctgagaatggatggggtgggatggcttttcagtactttctgctgagacatttttgtatattcatttctctctcaaggagcctctgtaacaaaagagaaaaaactgtctcgggttctgtgtgtggcacatgagtttgaaggatttctgagactattgttcaggactggcgttacagatgaaatatagattcaggaccagtgacggtgggatccttggcaggcggacataacgcctcgttaaggacagactgcccaccactctctttctttctttctctctttccgaaatcattttctataaattccactgggtatcagaaccttccttaggctgactggcgcttcgcagtctcctctccaagcccggatctattccccaaaattctctcgttcatgcttctagcttctcttcttagcttctctaggttcgcgtcatcggctttccttgtttcccaggttgaatccccagttccaagcggctcctgtaacagggagtgggagcccaccctcccactcgccgtgtagcactctgcatctctgagaagaaagtgaccaccccagcccagcacagattttcttcgtctttgagcacctgctcggagttcccgcccctcgtcgctccttggttttccctcattgcctacatagagtctgttggatgtcggtcaaggtatccccagcccctgccgtgggaaccgtttggggaaaaacagacctgatttatttatacttcaaagatgcccaatgattccctgtcgtctgtgtaccataaaaataaaaacagataaaaataagaagatcaatgtattcgacatctacacccaggcgtacagctctcagatgatcaactgggaagcgactgttgcccacccagagggaagaaaggggcaaagccggaggatgaggacgcggaccctgcaggccgctgcctcccaagtgagcgggttacaaattccgctaaccccagcccgccaccccgctattggctatttgaggcatgtgggggatttttccggactagaagtcttgtgttccacctggtttttcgggaccactcaacattcctgagctccatccctgccaaggtggagccagcacaggactgcaggcggagtctccagactcatccggaaacagccactgcgcggagccgggagcgcgtgtcaaacgagcacccacagaagctctgggcccgacacggttccacttgcttgatatttcagaaaagaaggaattatacctcagctgtaaagggaatacgggttacagctatcacaagtgccgggaaggtaagcgttcacttgcaaaagctgccctctctgaggctcgaactcaggaccttcagattatgagactgacgcgctgcccgctgcgctaagagggcgacgaagtgcatcaacgcgccagcttccacaggaatttcctaatttctttccccaggcgggttattttgggacttcagttttcttcgcccaaggtcgctagttttccaagattatttccaataggcacgcgtaggctcctttttagcccatcggaagaacctcacaatcggaagccatagtgtactgaacaattatgcctgacctcattctctattgatctggatcttcgtcccctcagagatataaggcaataattactgtccacagtctccttagttggaatagcgggctctcactaaatgctagttgaatgaatgaaaagctcccaaacatgcctgcagtttacacttacctctcttaatttaaatttgcatttccacttatgtcacctgagatagtcccctcaaaatatcaccaactgattttatgatgagtcttcatgttttcttcacctctatgttgcaaataccctattaaagattttattcccgtaatttcatttagtccaatttatttatttatttatttgccataaatctatacatcattatccccatcttactgatgaaactgaggctcagcagaactaaatccacagctgataaggggcaaaaccagatcttgaaagcagattttgttttccaaaaagcgtgctgccctctttctccctctagatcatgtaatctccccttttcctctccacaccaccacactcatttgttaagcaaatagctatagaattttagattcgttggtccattcaacaaactttaattcaccacctgccatgtacccggcatttatgctctagatttccaaggcatccttggccctttatccctcacatccctacaaacaccttaaatcattagttctcgaagtgcggtgcccagacccaccacataattctcgaggacacattccatttcaggtactgtgctacccgaaggctttgaggattcagaggaaattgagccatccctgacctcaggagctgacaggacaaactgtcctatctggtccggttcctatactctcaaacttccggattcttataaatgcatcttcctaaatattttattttgatactgtaactcccattctgcactagtttgctagggctgccataataaatatcatagactgagtgccttaaccaacagaaaattttctcagttctggaggctagaagggttgttagctttggtttctcctgaggcctctctccttggctcgcagatggtcacttaccttcttgctatattctcccacggtctctctctctacacatgtttccatcttttcttataagaactcctattgggagttagggtttcgacatgaatttgatgacaggtggggcgggacaaaattccaccatgacaggctcaaagttgtttacattttcaccctcatatttgcagtagactttgttactggaaaacactacttgcttttttttttttttaacacgtattttaaagccccttaattaaacagaccatatacctttccttatctaggaattcccattccagtgcctggtccacacatccattatttctcctcatctccattcctcaaggcccattcttgattctttcattcttatttgaaagaatgtagcatggaggaatgtagcatactagtttttccctcggaattgcatgactcattgtcatgcaaattacgcagtctcaggtgttccttttagcaacacaaagtagactaaggtgtgtacatttttgtacttgtcaaatgtggttagaataccaaatgaggtactgcctcacagatccctgagatgtcattacttggcataacaaaatcataatatagatatcataataatgcataagcagacaggaaaaaaccataataataacaaaactcattaagggatagccacgtaagtttatcagttagttctctctaaactctgtaatatgaatgtggccaatctctgggatttaataatacaaaaaacatgttttggtctcccagtgtcattttaatcttattcagtaggatatattctttccctatctccatatgaagacatacacagttttatgcctcatcccaggcaatacagtctcagtctcaaagttaagatgctgagctccatgtaacactctaaaatttaaacttgacataaagatcagatctcttcctttacctactgggcctgttgagtcagctaaaactatttggatagttttctaaggaaaatgtttcatctctcttttcttaccctaacattctaccatttgttaaccactgttctgagacttccgtgtttcaatcgtggtggaagatgagttaaagccagggaggggtggtggggagaataataaagttcttacttttaaatggtgttgtcattagccagtgtcatgctttccattcagctgtttgaatacgaataatttttttaatacgatccatgattgtggattctcgtgtgcatttcccttgatgatgatgtactctcctgtacccccttctttatgactgcttttccagccactgcaaaactcaaagcttccttttgcttctttttccttagttacgttcatccttccacatagcccactgggactggctcaaagttgacctcatgctagtgctccctctctcctgattcccacacctgtcttgtgggaaaggcctacatctggttgtccctgaaaagccctgggactacaggccaatcccaatatagaaggaacttcaggcagtcaatctgcccatttctcccctttacatttctcatgcatctaactaccgtatctcccatattttggtgccagtgattgaacttgttggcacctgtattagtccattgtcacactgctataaagaactactggagactgggtaatttatgaagaaaagaggtttcattgacccacagtgccacaggctgtataggaagcatggctgggaggcctcaagaaacttacaatcatggcggaaggcgaaggagaagcaagcatgccttaccatggcagagtcggagagaaagagcaaaggggaaagtgttacacacttttcaacaaccagatctcaggagaactcactcattgtcatgagaacagcatgagggaaatctgtctggaacaggtttgtgaacccattgaggtgttcatccagtgctgtttcagagaaatctctatttcaatctattcctatacattagttactgaaaaacaacagacaatcacaaaaacaagttgacctttttgtgatccttgagcccagttgcgaagggccctcgtgaccgggcctcatgccaaacaactcgttacaaaaagagctagggttccagactgggctgaagcttcatgagacttctcctcgtctgtgcgcagacagctggccaactctggagcccaggctgttgcttcccggtctgttggtgaatcctccatagtctggtgagtgtacatatatatgtatatacatatatatatatatatatatatatatatatatgtctttttccttcccattgcaatttgcttattatatcagtctgcttattatttcatttgcttattatatctgcattgccatttacgtgggataaaggttgtttacccttaaaggtgttgtgtgggtgtcttttcttctccctttacatgtcttccacacagaacatgtacacatgtatctacaggtgcatgtgtgtatgtagaagtgattgcacctgtgtttatgtatacatgtctgtgtacaccacatgcatgtgtaaatgtatgtgggtacacgtgcatgcatgtgtatgcatacatgcatgtacacatgcacaaaggtatctacacatacatgtgtatacatgcatgcatgcatgtttatgtatacatgcatgtacaccgtatgtatgtgtgtatgcatgtgtgtattttcagacgcatatgcatatgcatacatgcatgtacttgcatgtgcacacgtagctgcacattcacgtgtgtatgtatacatgtatgtacacgtgtgtgcatgtgtgagtgtgtaaagatatgtaaacatgtatgtgcaaatgcatgtgggtgtgtgtgcatggatgtaggtgtatccatgtattgtgtacacagtatgcatgcatgtatgtgtgtagatatatgtgcagatagacatgtgctcacacgtctgcatgtatgtgtgtacatgtgtatgtgtttacccacgtacgtgtgtatgcacgtgtgtacgcatgcatgtacatgcgtatgcatgtgtgtatgcatgcatgcacatgcgtatgcatgtgtgtatgcatgcatgcacacatgtatgcataaatgtatgcattgtgcacatgtatgcacatgtttgtatgaatgatgtatatatacatacacgtatacaccatgtataccagcctacaaatgcatctgtgcacacacatgtgaaggcgtgtgtatgcctgaatacaagtgtccatacatacgtgtgcatatccacacatacatgtgtacaacacgcatgtgtgcacacatgcatgtgcacacacaaaaattcgtgtgcaaacacatgcatgcatgacatatatgtgtacatggatatgtgggtatacatgcatgtgcatacacacgtgcacgtgcatgcacacatgcacacataatacatgtatatatacatacatgtttgcgtgaaaagcacgatgcatacatgcacacaaacataaatgtgcatacgcacgtacttgtgcatacaaatgcacatgtgtacccatacatgcattcagacgtttgtgcaatgtatacatacacctataagtacatacacacatatacactcatacatgtttgcacacacgcatacgtacacacatgcacgtgtacaaatacatgtgtgcgtgtgcatgcatttgtgcatattcattgattgtgtgcacaatatgtatgtgtgcatgtatgtgtgtatacgtgtatgtgtagatgcatacgtgtatgttaacatgcatgtacactcatgtaaacatgcatcaacacatttatacacgtatttatttgtgtatcaggtttgtatacacgtacctaaacatgcatgcgagcattcgtgcatgtatgtacacgagaatgcatatgtgtatgcatacgtgtatgtacacatataagcacaggcatctacacgtgtgcgtgcgcacctatgtgcacacttatgtatacatgtatgtgcacgtgcataaatgaattaagaaagaaacaattcacccaaacaaggaggaaaagatgaacatctcaagtacctatgagcatttttacatgcagaccccttactgacattggccaagacagatgacaagagatcatcaaggagagagttcattagaaaaagatactgctaacattagagaaacatagcatcaatcacccatagcatggatgctgttgagcttccacctgaaaaacaaacaacaacaacaacaaacctggcgggtagaaataggaacaggtttagcattacatccctccctccttttcctgggacctgcattgggccccataagcttggcatgaacctaagtgaataagacaccaaaggactgaagtttaccactaccttcagaattaggactcagagccaggaatttctttagactacataaccagtctatgcatatgtgaggatttggactgtagttcacactggctgcgcttccttatggaaacagtgactacaagatggaggatattaatgaaagatagcacacatctatactaaatgtcataacagcaaaaaccataagatagttactgacaatgagtcatgcaattccgagggaaaaactagtatgctacattcctccatgctacattctttcaaataagaatgaaagaatcaagaatgggccttgaagaatgaagatgaggagaaataatgggtgtgtggaccacgcaatggagtgggaattcctagataaggaaaggtatatggtctgtttaattaagggactctaaaatacttgttaaaaaaaacaaaaaaaacagcaagtagtgctttccagtaacaaagtctactgcaaatttctttctgtacatgggaaataaggactgtgggattctttgggtggatcccagcacctagagttggatctgatcaaaaagaagtgctcagtaaacatttacctactgctttggttgccttccccctgtggagtgctggcctccaggattgagcttgcatcataggtgttcagtaggaacttgcttagtggatttacaggttgaggttagaacccatcaggattcttttcctggaaagaacaggcatgtgttcttcccttccctctaagttttcacatagacactgggtgaggaaagagccctaaattgcttgaaaaattgattgctctttgagcaaagcaagaaaccctcctgtggaagggcatcatttgggcatatatcggggtctcagtacgaagatgagtgctcaagacgtcaagatgcttaagcagagaatctgaccagaatgttcgtggtacagagaaacagttttgttgggagaaggatgacaattgaggctttcgaatataagctaaataagcttcaaagggtatacaaaaaagaatcaggtacaaatcctttactacattcttttgtacaaatcaatttttgtctagaaaatcataccttactatgcatccctattgtgttcctccaccatctattttgtttttttaagcgttatttcattttcatgttcacagaagcttgttgctacaactacatgagcaaaacagccagtagcaacagaaatgcattaatatctctcctcagacctttaaagcattttccttaaaggtgaacaatattccgcatacaaggactttttcaggactatgtgccagaaattatactgaatgtttcttaattttcacgtaaatcggtcaatatagtttttcagcttccccaagtattattaccccagtgttataaatgacactgaagtaaagggcatatcactctctttattctgtgtaggtgtgtctgcttacagctaaggatttcctaaattatagttttgtaaacattagttctaaatcattgtgatcacttgaattttgaaaatgtcaaaaccaatcacatttatgtagtagaaaatagaggtttgaggtgcattggctcgctgttttatttactatggatcagtggagtagaaattcccatcgcggaagagggttcattcctgtctctcagcctcagcaaagttaaacatttcagaccttgcctgactttggatctattgcgcatgctctgtcctttaccactatccagtcctgggggcatatagagccactcagagccttagaggtaccctcagcgaaatggaaccaatcaccatatagtgtagcctattgttcatctgaccaaaatgcactatgttgcgatagcatggattctacagacccgtgaagcccatttggaccacaagacactctttccatcatgcctgcacacatatccctcactcttcattgattcatgcagacttttaaaagtatttagcaataagcatcctacccccaagaagcttatgatctcatggagaagatggccaagcaacagacaatcccgacatggtgaatgccgctaaaacaaatgcttacctggatctccgtgagtgctaggaggaaagcaacccaaactcagaaaagtaggagaggtgtcagggaagacattttccagaagatggtttcgtgtctaacaaagccgtgagacgagcaaaggggaggtgaaaggctcagcgttctatgggacatttccttaattccagtatctctcgagttgagtgtgggaagctaaaagggaggaaatagaaatgaaaaatgggagttcttgagaggctttacttaccctgcacaagccaaggacaggtctgcgggaagtaagcagatgcagttaggaaagcccatatcaggagttagtcacgacagagaaagatttgtacactttggaaatcataaaaggatgaaaagcccaggtccttatttccgtgttttcgcctgtttttcacgttcctcccggatttcaatttctttctggaatctcacctctcctcatcatctgctcttgcaggaacactaaactggaaacgcaaccctacgattcagcgaactatgtcccatcaagattactgggtacaaatacatttactttcgtgttctcttgtgactgtctgtatcactgcacacgtttgttactgtgaaacaagcattaaaagtctgtgtagattactgagtacatatgcatttctttttttttcttttttttttattatactttaagttttagggtacatgtgcacattgtgcaggttggttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgatcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtaattctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatggtatctcatagtggttttgatttccatttctctgatggccagtgatgatgagcattttttcatgtgttttttggctgcataaatgtcttcttttgagaagtgtctgttcatgtccttcgcccactttttgatggggttgtttgtttttttattgtaaatttgtttgagttcattgtagattctggatattagccctttgtcagatgagtaggttgcgaaaattttctcccattttgtaggttgcctgttcactgtgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggttttcatggttttaggtctaacgtttaaatctttaatccatcttgaattgatttttgtataaggtgtaaggaagggatccagtttcagctttctccatatggctagccagttttcccagcaccatttattaaatttcttttcttgttctcccgtgacttttgatatcactgcacacaactgttactgtaagatgaacattaaaaagtcacgtctggccagtacggggatcgaacccgcgaccttagcgttattagcaccacgctctaaccaactgagctaaccggccccgcttactaaaaccccccctaaacctcttgagaagtttaaaggcgaacgttatttcaatcaccaaagaaacttttctgaacttctcggaactggaaagaacctgcgatctttgctaacttgtttatgatcctcggcaaatttctccgaaccctgacatttcaattaaaatacaattctgaggaaggaaagttcaaatgtcacctgcttcactgtttcatgacaaggggtttcagtgaccacccttttaaacgcaacgccatcaccttccgccggtactttggcctgcccttctcactcctttctactttgcttccgtagcttctgagcaacccgtgaagaaattgacggaaaacggaaggaattaccgccagtttctttccacgggccgtcaaggccaatataagtccccacccaggctcctctgctcgtaacttccagcacgattcccactgtattagcccatgtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctcaatagatacgtttcgaataattaaataaaagaagtctcaaccaacccccttgctgtattacagatggtccagctctctgcctagactattgtgctaatgtcctgttccttctcccggcttttgaactagattctcacctctctccaatccatctttcgcagggctggcctgtctttccgcctcacttctgaaattctatccattgccgcctctgtgcaaaccgactctggttaatacttcagtcggtatggctcccctcttccgcactttgcactgcgagaaatgcccttctttgaggcagctggaggcctcctcctcctgagagcttaattgtggacacagccttgagtagaggcgaaaaggaaagaaggctgggagacaatcggggaaaaacacacacctttggtctggtttgaaagctggcgcccgaaaaggaacaagaaaaaaaacacgcttcggaagtgtctgagattgctgcggccataaagcagagcactaaccctggtactgatacgggaggggagcaagactccacccccgggcctgtgcccatgaacctaggtgaggaggggcacttcttcctccgcgcccaaatgttgcatttcccaagaccaccctggcccgccacgcccccatcctgtgcctataaaaacccccgagaccctagcgggcacagacacaagcggttggacatgaagaggaacacaccggcgggagaacacagaacacccaccctctctttagtcaccctggaggcctcggagaaggcggtttcagtgatccgtgaagagaccctgagtcttttacatcccggagaatgacaagagagtacctgggcgacgtaactttctgggttttccggagatgcggttttctacacgccaggggccaagcctgagaaataggtggacggcaaggacaggagctctctccgcgccacaaacgcccctgctcacacctgggttccttgattttcctgcctatataaccgagccacccatggccgggctccgagctctcattctgcggactgggacaaaggggttaactgtgatgtgctttgtataaccccaggattctgcacttgcccaagggcgaggtgcaaatccaaaatcacgcacgactgaacgccgagatcagctgagtcctgagtgcctcacgacacaaaatccgtatgatttttaaaagcgctgtatttgtgctgacaatgcatgtcagatcccatctgtctttagctcaatgtgtgacgttagacacgtcgttttgctcctcaactttcttatttggaaaaaaaaaaacgagtgttctagatttgcagagggccttttcagagctaagttccagtagct

SEQ ID NO: 181 - DNA, 4590 bp, Homo sapiens
tcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaa

SEQ ID NO: 182 - DNA, 10090 bp, Homo sapiens
attcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaag

SEQ ID NO: 183 - DNA, 12783 bp, Homo sapiens
gcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaag

SEQ ID NO: 184 - DNA, 15782 bp, Homo sapiens
agtatagatgtgagcctttaattttgcaccatagttattagataggcgtgaaatttcttgtacatatatttggatttaaaatgactattgtcctttcttgaaatttatatattgtaggccaggcacggtggctcatgcctgtaatcccagcactctgggaggctgaggcaggcggatcacctgaagtcaggagatggagaccagcctggccaacatggtgaaacctcatctctactaaaaatacaaaaattagctgagcctaggggcgggtgcctgtaattccagctacttgggaggctgaggcaggagaatcacttgagcctgggaggcggaggttgcagtgagttgagatcgtgccattgcactccagcctgggtgacaagagcaagactccatctcaaaaaaaaagaaaaaagaaaaagaaaagaaatttatatattgttattattattgccattctggcgtagactttaccttctgaagattaaaccatatgtcagggcttctgaaccccagcacaagtaacatactgggccagataattttttgttgttggggctgtcctatgccttgtaagttgctcaacaccatccctagcccctacctgctatatgccagtagcactgcccaattgcgacaccccaaaatatctccagacagacatgcctattgtcgcctggtgaacaaaactgtccctgtttagggaactctgcactatgtggctttatctgagtgtcaggaggaagacaccctacaggtgtttcataaattggaaagagaaatgatttgtgcttgctcattttccatttaatgttttatttttatttttaattttaattttttagagacagcgtcttgctcagtcatccaggctggagtgcagtggcacaatcattcatagttcactgaagcctcaaacgcctagctccagccatcctcctgcctcagcctcctgagtagctgggacaacagttgtgtgccaccatgcccagctaatttttttgtagagatgggttcttgccatattgtccaggctagtcttgaactcctgagctcaagcaatctgcctgccttggcctcccagagtgctgggattacaggcatgggccactgtgcttggcctattttgtttctaatattaagccagataatactccagaactttcctttatatttaaaaaaatttaaattattaacaaagtaattcagccaatattcaagtgattcttggcattgaagacaatgaaaaatacacattccctgccctctaggttcttactgcctagcttcaatcaaatgctggctttgtgatttaacttaggcatagttcttctgtacaactgtaataggcatatagaatttctgtctgtaatttctcttgttttctttctctttttttactaagttaaaaagtaaaattaatgctaagtactaaattaaaatcctattactgatgttgtcttaactacataagaattgaggaaattaaatgtgaaaaatatttctcccaggccatttcctaatttagtcatgaaatgtccttacttattaatgagcttatctttatttattaatgaatacaatgtcagataatattacaggatttagactctgcaaggatgagtgagctagagtggcagtttgattcacagctttgaatttgatgatttattctatgtgaacacttatatttcagtcattttctatattaatatccaaatcagtgagcaaggaaataggctttagtctccacgtaaaaaattgaaattcctcataatttttcttttctgaaaaggaaatgtgataagttttttgggttaatcttctcctattcattttttctaaggtgatctctcaggttcgaaagttttttacgagagatgatacaaatgccaaaatatagcaagtaaggcttgaattgaatatggtctctggaaaaacaatctcttgtttattgggggtgactgctttgctaggaggatgagtaggtacagggagttccctgagaccaggatgaacaaccctggctcatggagaaaatatcggtaagtctggaaaagtgatgcttccccagtgcactgtcgtgggaatgtaacaccacacatcacttcctgtattagtctagaatgctgcccagtcccctcaagtatagaacatggcgctggaaactaaacatgaatggccttggtatgagttggtaaatcgaaggggtaaaggaaaaatgactcagaaaatactaaaaagagcaaggatggataggtgagaatcgcatggaaacgtgagagtgggggccagatttggggagaaaatattatttttgacacctaaattatttttatggtattgaaattgttaatagccaatgcaatacaagttgcaagaaaattgatacactgatacttgctttgtgagtttctactgctcttttggaaagcaatatggccataaagtttaaaaaccagaaagcactcatcttgtttaatttagtaagcctatttctggaaatttttcttaaaatcataaaaaagaaggaaaaagaacaaagctaatacgtgatgatgttcaatgcagaaatatttggtaaagcaaaacagtgagaggaatttaaatatattcaaattattgaatcagtagatacagccacttaatggaatatgacacaacttttacaaaatatatttgtgaagactatatattatatggaaaaatgcctgtcacgtaagaaaaccagatatcaacttatatgtaccttatgactgtaattataataaaaatctgcatacacagtagaacaggaaaagaatatgcatagaacaaagtttgtattttacatgagggattagagattttttgtttattttgtgtattcagcattatatatcttcgtgaagtagtttgtgtgtctaaaaaataatttaaaaatactgttggcagggttaagcaaacagccagtcacgcagagtttcagaatttttctggatctactgcataatagttcagcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaag

SEQ ID NO: 185 - DNA, 12853 bp, Homo sapiens
agtatagatgtgagcctttaattttgcaccatagttattagataggcgtgaaatttcttgtacatatatttggatttaaaatgactattgtcctttcttgaaatttatatattgtaggccaggcacggtggctcatgcctgtaatcccagcactctgggaggctgaggcaggcggatcacctgaagtcaggagatggagaccagcctggccaacatggtgaaacctcatctctactaaaaatacaaaaattagctgagcctaggggcgggtgcctgtaattccagctacttgggaggctgaggcaggagaatcacttgagcctgggaggcggaggttgcagtgagttgagatcgtgccattgcactccagcctgggtgacaagagcaagactccatctcaaaaaaaaagaaaaaagaaaaagaaaagaaatttatatattgttattattattgccattctggcgtagactttaccttctgaagattaaaccatatgtcagggcttctgaaccccagcacaagtaacatactgggccagataattttttgttgttggggctgtcctatgccttgtaagttgctcaacaccatccctagcccctacctgctatatgccagtagcactgcccaattgcgacaccccaaaatatctccagacagacatgcctattgtcgcctggtgaacaaaactgtccctgtttagggaactctgcactatgtggctttatctgagtgtcaggaggaagacaccctacaggtgtttcataaattggaaagagaaatgatttgtgcttgctcattttccatttaatgttttatttttatttttaattttaattttttagagacagcgtcttgctcagtcatccaggctggagtgcagtggcacaatcattcatagttcactgaagcctcaaacgcctagctccagccatcctcctgcctcagcctcctgagtagctgggacaacagttgtgtgccaccatgcccagctaatttttttgtagagatgggttcttgccatattgtccaggctagtcttgaactcctgagctcaagcaatctgcctgccttggcctcccagagtgctgggattacaggcatgggccactgtgcttggcctattttgtttctaatattaagccagataatactccagaactttcctttatatttaaaaaaatttaaattattaacaaagtaattcagccaatattcaagtgattcttggcattgaagacaatgaaaaatacacattccctgccctctaggttcttactgcctagcttcaatcaaatgctggctttgtgatttaacttaggcatagttcttctgtacaactgtaataggcatatagaatttctgtctgtaatttctcttgttttctttctctttttttactaagttaaaaagtaaaattaatgctaagtactaaattaaaatcctattactgatgttgtcttaactacataagaattgaggaaattaaatgtgaaaaatatttctcccaggccatttcctaatttagtcatgaaatgtccttacttattaatgagcttatctttatttattaatgaatacaatgtcagataatattacaggatttagactctgcaaggatgagtgagctagagtggcagtttgattcacagctttgaatttgatgatttattctatgtgaacacttatatttcagtcattttctatattaatatccaaatcagtgagcaaggaaataggctttagtctccacgtaaaaaattgaaattcctcataatttttcttttctgaaaaggaaatgtgataagttttttgggttaatcttctcctattcattttttctaaggtgatctctcaggttcgaaagttttttacgagagatgatacaaatgccaaaatatagcaagtaaggcttgaattgaatatggtctctggaaaaacaatctcttgtttattgggggtgactgctttgctaggaggatgagtaggtacagggagttccctgagaccaggatgaacaaccctggctcatggagaaaatatcggtaagtctggaaaagtgatgcttccccagtgcactgtcgtgggaatgtaacaccacacatcacttcctgtattagtctagaatgctgcccagtcccctcaagtatagaacatggcgctggaaactaaacatgaatggccttggtatgagttggtaaatcgaaggggtaaaggaaaaatgactcagaaaatactaaaaagagcaaggatggataggtgagaatcgcatggaaacgtgagagtgggggccagatttggggagaaaatattatttttgacacctaaattatttttatggtattgaaattgttaatagccaatgcaatacaagttgcaagaaaattgatacactgatacttgctttgtgagtttctactgctcttttggaaagcaatatggccataaagtttaaaaaccagaaagcactcatcttgtttaatttagtaagcctatttctggaaatttttcttaaaatcataaaaaagaaggaaaaagaacaaagctaatacgtgatgatgttcaatgcagaaatatttggtaaagcaaaacagtgagaggaatttaaatatattcaaattattgaatcagtagatacagccacttaatggaatatgacacaacttttacaaaatatatttgtgaagactatatattatatggaaaaatgcctgtcacgtaagaaaaccagatatcaacttatatgtaccttatgactgtaattataataaaaatctgcatacacagtagaacaggaaaagaatatgcatagaacaaagtttgtattttacatgagggattagagattttttgtttattttgtgtattcagcattatatatcttcgtgaagtagtttgtgtgtctaaaaaataatttaaaaatactgttggcagggttaagcaaacagccagtcacgcagagtttcagaatttttctggatctactgcataatagttcagcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaa

SEQ ID NO: 186 - DNA, 12948 bp, Homo sapiens
attcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaagtgccccttttttaggaataccatacagaaaagtcacatatttgaacataactacttgcctaatccttttaggattttcttttccaatttttgctccttattgctgacgggctctttgacagtgggtggctctccagaagcaacgggttctcttccagcctcttcagttgtttcctcacagtccccatcctcgttgtcaggtgattctgcattctcaggctgctcactggccctggcagagccctctttccctgctgtgctggcagcagacccataagtgttaatgatgtcttccagctgtcgattcagctcttcagagatatcggggtgcacacttgcctctttctctggtggttggactggggttggagaatcctggccatcttccttctccaggccattgtgactgggtaatgatgaactgtcacctggaggtgttgactgtcgttccgctgagagctgttcagagtgattagcctccatcttgggagtagtatctagtggtaagcacagttaggctttatgtagctaacctacttgctacatatcaatgctacatttcaatggtaaggatatcccccaagtgaataccaactaattatagtctctaacgtagagaaaggcaatgtcctttcacaaaccattgatgttactaagggaggagaccacccctcatatcgtcttatgcccaatttctgcctccaaagaagaagtaaaaactaaaacgcagacatgaaatccacaggcagacagcctggtgccgcgccctgagcctggtagttaaaaattgacccctgacctaataggttatgttatctatagattacagacattgtatagaaaagcactgtgaaaatccctatcctgttttgtttcgatctaattaccggtgcatgcagcccccagtcacgtaccccctgcttgctcaatcaatcacaaccctctcacgtgcacgcacttagagttgtgagcccttaaaagggacaagaaatgctcactcagggagctcggctcttgagacaggagtcttgctgacgctcccggccgattaaactgcttccttctttaactgggtgtctgaagggttttgtctgcggcttgtcctgctgcattacaattattaaagtagggacagtggaaagttgtttttccaaatcaagtcacactgctggcatatttttggttttgatcttcagttttcagtagcattccttattattcacattaagaaagtaattcatgctatttttctttgtggccatatttgtcattttgcttacactagtcagtttgtgttaccattttcctgtataattctatgtagattaacaatcactgggggtacatgactgtatatatttaaaatgtttaaatataaagtggtattagttttctttcaaagttaaaatatttaatagaagagccattgaatttatttaaataactcataagaataacatctctaagctctatttgatccataaatcaatattttgcttagtgtgaatattttgatgtaaatgcattattacactggatagaggagacatttctcacttttctggcattttctttttcagataagcaacacgaatgctttttttgaggcttaaactggcatcatttttagattaagacagggaatgagggaaggtataaataaatagacaaagtagtatggaaacacgggccaggtgctgtggctcatgtctgtaatcccagcactttaggaagccgaggcgggtggatccttgaggccaggagaccagcctggccaacatggtgaaaccctgtctctactaaaaatacaaaaattagccaggtgtggtggcgggcaccggtagtcccagctacttgggaggctgaggtatgagaattgcttgaacttgggaggcggaggctgtagtgagccaagatcgtgccactgcactccagcctgggtgacagagcaagacttcgtctcaaaaactaaacaaaacaaaagcatgatgatacttataacaacaattccttaaatttctataatactcttttattccaatatataaaccaattttttaaaagagaaaaacagattacaactttctcttctaagtcaggaagctctagaaaaacttaatgatttttaagaagtagcaatgtttcataaacaaggaggagaccaactcgagaaataattcagcaataataagggcccttaggaaagggtgagagatggtactgagtcagagattccagggtttctgactattaccacttctagagttgcaatagatttggtttaggcctttaagttatggtgcattttatttgtaaataatatttaacagtgatgctgctaaatagcagcataaaaatgtggcaagatcctcataattcacaggttttgctgttgtggtaacatgaaagtgaaaacaaaagcatactgttctacaactgcacagcttccttttcctgttctcagggcagtagatgtcaattgaatgctcagacaccaacaagaacagaaaattcaacacacagatgttgccactgacttgtgatgctcaccaaacactcataacttagaggaagtactttttttctttcactggtttgaattcaccaacttgattatcaaataatgcagcagtttcattattttcatcactgggatttcttttcctgacctcacttgttgattgcactcatctatatataacttaggcctcccctgaacacggagaaagacacacggcacctgctgtccagccagaagttattttaagctattctaaaatgagtcatgccgtttagcacttcatccttgaaaatcaagagaatcgtttttcagtcaaattgaaaacagtaaacatttag

SEQ ID NO: 187 - DNA, 7161 bp, Homo sapiens
attcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaa

SEQ ID NO: 188 - DNA, 7519 bp, Homo sapiens
tcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaag

SEQ ID NO: 189 - DNA, 9294 bp, Homo sapiens
cacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtccttggcctctgtctgtactttctgggcgaggggacctggtggagattgtaccagtccagggggcaggcaaaaggggagactggaggcatgaatgagcttctaatgggatttggccctgtccggaggtcagggtagaactgcaggaagggaatggcacagggagggtgtggtggagcaggggctgggtctgggaaagggctgattctctggttggagggctgtgtgggagagacgggattgaggaatgtacctggagagtgtatgttggggtgcctatggaggggtgtgtggtagggagagactaggtggaggtatctgaatgttttgcggggcgggttgtggggcacaaaagggtagagatcattagagagttggtgagaatgtgcaaagtataaatgcagaaatgcctgtggtgggaaagggacctggtgcatggatgcctccgctctctcaggtattgtcggttcactgcatggacaaagaaactgaggcccagagaagcgacatgacttgccctaggtcatatcattggggtagcagtgaggcctctttctgctgcaagtatcttaaaaaccaactcaaattggtctaggtgaggaggggatttactggtgatgggaaatgaaagtccagaggtcaggcaacccttaggtagggccagagccagcagctctcaggctgaattccttcccagtagtcacaaacattccaggtgtcacctaataacaggtaggatttattgagcacttcctatgtgccagacactgtgcaaagtgctttctttttcatttaattaaaaaatttaagacagcacccaggctggagtgcagtggctcgatcgcagcgtactgcagcctcaaccccctgggctcaaaagatcctcccacgtcagcctcccaagtaactgggactacaggtgtgtgacaccatgcccggccaattttttttctttttctttttctttttttttttttaatagagacagggcctcactgtattgccctggctggtctcaaactcctgggctcaagtgatcctcctgcctcagcctcccaaagtgctgggattacaagcatgagccactgcgcctggcccaaagtgctttcttaactgtattgactcatctttttgtcacaacagggctatagtaggtgttataattatccctattttacaaacagggtatcgaggctcctaaagtaagggttggaactgagacttgaacccagacaatcctgccccagaggccaggctcttaaccacaaatccaccatgtacatcaatactgtgcctttcagagaaagaaaacatctctgttccacaattttcagcaaacatcctaagatcggttctgattggattggcttagtctgcctgaactaattattgtggtggaatttgctgattggcctagcctgagtattgtgcaggatgggaaaattctgacggggttgggtgctggttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtg

SEQ ID NO: 190 - DNA, 1481 bp, Homo sapiens
agggtaatgttttctgaacttcaaagccacagaacataaacattaaatcctaggaaagaaatgctatcttcacaattaatggcatatcaaagtcagtgtgtgagaatgtgagtgtgtgtgtgtgtgtgtgtgtgtgtgtgtagttgtgtgtttaaataaatttccacagccataactgacaattgtagattgtaacatttacatatatgtgaaagctcagcaaacacactgcagatataggcttttgataagtacttttagtgaaatctattcataaaataatttgctcaaagtaaaaaaaaataagaatggataaatcgtacagtaaaaagagcaataagttgtaaaaagagaaaaactaaaggtaaaagttattctaggtataaatctcactgtccagttatttcttacctaaattttacattatctgttcagacatgttaagtcaatctaaacttatattccatatatatataattccatatataaaaatatatatattccatatataaaaatatatatattccatatataaaaatatatatattccacatatataaatatgtatatattccatatataaaaatatatattccatatataaaaatatatattccatatataaatatataccatatatataaatatatatattccatatataaatatatatattccatatatataaatatatatattccatatataaatatatatattccatatatataaatatatatataaatatatatattccatatatataaatatatatataaatatatatattcatatataaatatatatatattccatatataaaaatatatatatattccatatataaaaatatatatatattccatatatataaatatatatatattccatatatataaatatatatatattccatatatataaatatatatatattccatatatataaatatatatatattccatatatataaatatatatatattccatatataatatatgtattatgtatctccatagaaaactttattattcaaactcctaaaggtattctttagtatatttcacagtttattctgtgtgtgaaagaagtattttctcacttataaatgactagattcctgatccaagtaagatgtgtatggtttcactatcaaaggctagaagagtcatatcattggctctccaggccactattgcataagcaagctggaaatcaaattgaaccaggaggcgcataatttatgtattaaaactgcagaagaaaccacagctgaaaaattatcttggagtgaacaaatgactgaagtatcagaattgcattgctttagttcaacaatatcttacaaaccccattctaaagggacagattatccatcagagaaaatgaatacattctaagcatagaatttatcaaatagtccatctttagtaccaatttttcttttgattcttgatcactttgagtacaaaaaaagat

SEQ ID NO: 191 - DNA, 17358 bp, Homo sapiens
acgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaa

SEQ ID NO: 192 - DNA, 31633 bp, Homo sapiens
aggcctccatgcataaaaaaccactactctgagtttatacattaggtctctaaagaaaccaactcgttaacaaagacaaacttaggaaaccgggctgcaataccagatcactttcaacttgtcctgctcctgtgacttactgtaaggaagctcttaaacaaggtcctgattttataatgtcgtataccttagatatgagaaaatggaaaaaatatgacctaccttatagagtattacagatgattaactgagttatcacagagaatgtacctaatatcacataggataatacatgtccaatagatgtaagtgacaacatgagattaacgaggctgagtcacacctcaatatcatgatgctaggtaattattttctcaatacttccatagagattattagaaatactaatatcaaatatttttccccttagtggtgctccaggagctcagagattccaacagctctaagttccaggtctctgagtttatcctgatgggattccctggcattcacagttggcagcactggctctccctgcccctggctctgctctacctcttagctctcagtgccaacatccttatcctgatcatcatcaacaaagaggcagcactgcaccagcctatgtactatttcctgggcatcttggctatggcagacataggcctggctaccaccatcatgcctaagattttggccatcttatggttcaatgctaagaccatcagtctcctggagtgctttgctcagatgtatgccatacattgctttgtggccatggaatcaagtacctttgtctgcatggctattgatagatatgtagccatttgtcgaccgctacgatatccatcaatcatcactgaatcttttgttttcaaagcaaacgggttcatggcactgagaaacagcctgtgtctcatctcagtgcctctgttggctgcccagaggcattactgctcccagaatcaaattgagcactgtctttgttctaaccttggagtcactagcctatcttgtgatgatcgaagaatcaatagcattaaccaggtccttttggcttggacactcatgggaagtgacctgggtttgattattttatcatatgctctaatactttactctgtcctgaagctgaactctccagaagctgcatccaaggccttaagtacctgcacctcccacctcatcttaatccttttcttctacacagtcatcattgtgatttccattactcgtagtacaggaatgagagttccccttattccagttctacttaatgtgctacacaatgtcattccccctgccctgaaccccatggtatatgcactcaagaacaaggaactcaggcaaggcttatacaaggtacttagactggagtgaagggcacctgatatggaaaagatattcattttttgaaaattttcttcacatgtttttatatcatattctccaactgctgcaaatggcagaacaacaaagaaatagcataatgaattggtggcaacaactgacactttagaacaaaggagatagaagtaatatttgaaatatttgggagtcaagcaaaaatcttcatcacaaagggtaacagtgatgctatttgtctcaaggaattcaaagaaaagactaatgtaatctacatttcatgttcttacccacttgtcttagctaaaacttccagacagtgttgaatagaagtagttagagcagatattgtgtcaatctattccttttaattgaagagcttaatattttacatttgatgtaataattgataaaataggagatacttctgcattttcatgatttgctttattatgtgtcttatatttttaatttgcaaaggacttgaatagacatttctctaagattatatgcaaatgtccaaaaaatacatgaaaagatgctcaacataactagtcattaatcattaggcaaattcaatcaaaaccacaataacacacccctttaccccctatattatacaacaccacaataacacacccctttacccccatattatacatataaatgtactgcaaatttatttttttgcaataagagattagtgtttgcaagtatatggatacactgaaatctcaatacattgttgggaagtaaaaatggcacagtggctgtggaagagtttggcaattactaagaaacttcagtgccattaacatatgacccaggacccaacttttaataatacacccaacataattgaaaaaaatgttaatacaaaaacctgtacacaaatgtttacagtagcattattagccaaaaagtagaaacaacctgtatatctataagctgtgtcttgttctgttttgtgttgttacaacagaatacctaatactgagttagaaatataggtttatttagctcatagttctgcaggcagggtacttcaaggacatgtccctggcttcatctgaggactttggtgttgcctcataacatggcagacaaggtcaaagggaaaacagacatgtgcaaagagacaaaacccaacgggcttcccagctttataacaactcactgtcatgacaaatccatctcccagagaactgatccagttatgtaacagagaaaactcagtaactgccacaagaatagcaccaagtcattcatgaggaatccatccccaggacccaaacatctcttactgggccccacttcccaataccactacagtggggatcaaatttcaacctgatttttggtggagacaagcaaaccctatccacaccatagcagctactgaatggataaacaaaattaagtgtatctatactaggaattattatttaataaaaagtacctatatgagatgatagatatactaatcagcttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaaatgacataatgactgttggaagttcattgtatagcagttatagcattgcctctgtgagcaggaaataaaaaaaagagtaatttcaaggagtgactgaccatcagtcttctttcccataatggctattttgttttccttgtagatcaatgactatatttgttctattatgtttaatatgtgatatatacactgtctgggtgtgtgccttaagcattaggtgttgacaggaaaaactgagtctagtcagtacatttggacctgaatatctggggtctttgttatcatgtagtccattctccaggccaacgttggccatgaactgaacaactctgtggtcaagaattgattaaatatttgctctattctaggtgctcaccatcttagagatctccgttgtattctgaaatgttaacagacttcattagttcctgtgggcttacctttcaaattaaatctgtcctaatggacatactgacaatattttcaatctagttttagcccaaactccacccttttggtttgcagaaaacctaaatacagaaaaatatgaatcatccccttgtagctgtagttttcttgaagcgaaatcatagaatgatcttagaggcaaataaataataataataataatccactttctaatatcagcaaaagaccacttgttttataagtaccatgatatatagaggatgaaggatcattaaaaatgcaagaacttatgagaatccaatgttttcctaagattacagtctagtctaattgactctagagtcaattcagtgaaaataaagatgcttatcatcttaaacaaaataaattgacattccctttagaacatagtgctttatattctacccatatcaaaacttcagccatagaatcaaatatttttgaggcttaaaataaagaatatttttatcaaatatttttgaggctatgtaatctccaaaactaagtttcttttgtatacagaagatgttcaatacgtttttcaaggcccacagaagaacaggcagtggtagaacaaggaccaacaaaacacttctgaatagtaagggagagaatatttggtgtgatagtgtgctgtgagaaaataagaacaaactcaaagttatgaccacagaatagatgaaaataggcttcacgggtctgaagaagtgggctatatcagccggaatgtgttgattaaaattttttaaaaggagcaagttgtgtgatgggggcatatcccatatagaaggatattggaggaaaactaagtaggctttctaatttaaaaatatcaatattgatatttatagttcctccttgacatattggaggtgacccacctgtcacttcagggatgtcactattgaaaatttaaggttgtataaaactggctatcctattttcatatgtgtcttttataaaatttttatgtccttattttatgaaatattagggctgtataaatgaactcttgtcacttttctaattgagatataattcaaataacattactatcatgtgaaatagaggcaactcactgaaaagaagacaaaacacagaaaagtatggaatgaggctgtcatctctctttttttcagatcacagaaaaaattcttttctctcagaaatgctgcttttagctttcacagccagagggaataaatagaatacttcctgcaaagattgtttcagtaattgaaatgtgaatattttatccaaagtgaaaatggaacatacaagccagtttgtctgctgcaccattttaaaagctaggagaataactcttctgacaactctcttactcatcctcatttctcagctactgtaatctgcacccatccctttaataagaataaagaaatctcagttcagaaatctgctcaccctaatgatcagtgatgttgagctttttctcatatgattgttggccacatacgtgttttcttctgagatgtgtctgttcatatccctttcctactttttaataggttgtttttttcttctaaatttaagttccttaaagatctggatattagacctttgtcagatacatagtttgcaaaaatgttctcctatcctgtaggctgtctgtttactctgttgatagtttcttttgctgtgcataactcccataggagggagagaatcaggaaaaatatctaatggatactaggcctaatacctgggtgatgaaataatctgtacaacaaacctccatgacacatattaacttatgtaacaaacttccaaatcctgcacatgtaagcctgaacttaaaataaaagcttaaacaaaagtaaatctgcttaccctgaaaactaccggagttcctcaagaaactgaagacctatccatggatcaagtcatatttatgtctatatgatcctcttggtcctgaaggagaaatataatacctacattgagaccttgggaggcaagtggaggagggaacatttctattatctgtccatatgtgtgtgtacgtgcatgcatgcatgtgtgtatgttgtggatgttttatattctgaagttgagtaatggaaaacacttggttgttattgtctctactgtagtctcagaagagaagtgatttccccggtgaatgcatttgtgtatgtgtgtatgtttagaatatgaacaaaagagaattaagaatcaggtatatctgggtcctaaggatactggctaagccagtgggagcagtcttcagaactattttgacgtcattatagtctgggactcctggggacataattttttacaggtacagcagagatacatatgtctgaaaccacttggagtatcataattaaatccttttgagaggcacacctgcctcttttttcaaaacttagcacaatgtcatgcacaaaattagtactgaaaaagatgtttttaaagaaaacttaaataatgccggtatgcaaacaattgagttgtatatgtgaacttttatttcatgtctccaatatatttgcttattatttataacatttttatgaacatgatttggaattatctagacatatttttcactctgtgaaaaatgagtaatttgcttctttctttcctatttgtatgattttttcttgccttattgcactggttaagatcttccttctatgcaatgtttaccaagagtagcaataatgaatatctttgcttcattactaaggactgggtataatgatgcctactgagggtaatgaaacttagttccaaatgattatataaagacctagactaatggtacagtgcagaagcatagctatgccataataaaaaataatatatttcacttaacaatgccctctaggttcatctatgttgttgcttgtgacagaattttctgaattttttaaggccaaatagtattccattgtgtacatattccatatttttaaacccattcattcattgatggacacattttgactattgcaaataatactgcaatgaacacgaggttgcagacatctcattaacatattgatttcaatttctttgagcatatacccagtgagactgctggatcatatggtaattccgtgtttgattttttgaggaacctctatactgttttctaaaagaactatactaatttaaattcccaacaagagtgtataatggttcacttttctcaacattttcatcaacagctcttatctttcatccttttgataatagccaatgtaacaggtgtgaggtaatgtcttattatggttttaatttgcagttctctaaagattagtgatgttgagcatttcctcacatactttttggccacttgtatgtcttcttttgagacatttttattcaagtcctttctctactttttatagggttttttttttggcaattgagtagtttgaattccttgtttattttggatattagtccttatccagcatatgatttgcaaattttttttcaatctgagaagttatctctctattggtatttttggctatacagaagcattttaatataatccaatctcaattgtttatttttgcttttgttgcctggtgcttttggggtcacagtcattaaatctttgcccaaaccaatgtcatggagcttttctcctatgttttcttttattaatttaatgtttcaagttttatatttgaatctttaatttattttgagttgattcttgtataagagacaagctaagggttcatttatattttctgtatgtggatatcaatttttcccaataccatttattgaagacaggtccttttctttttaaatgtgtggtttgcttctgggatctctagcccattccattggtcaatgtatctgtttttatgccagtaccatgctgttctgattactatagctttgcaatatattttgaaattctgtagtgtggtgtctccagctttattctttttggtcaatattgctttgactaattaaggtcttttatagttccatagaaattttaagatttttttccatttctgtgaagaatgacattggaatttttatagagattgcattgaatctgcagattgctttgggctttatagacattttaagaatattaattcttccagtccatgaacacgagatatcattccatttatttatgtcatcttcaatttctcttttttaacttttattttagatttggtggtacttatatttctaattttatactgttactatattttattgattgtcatagcattataatacatttttaaattagtgtaagcactgtcaattaggtccttctttaaaaagattctttggatatcctttgtcctttgcatttccatagataatttagaattaattgtgtaatttctacaaaaagctgtcttggatttttgtgaagacaatattgaacctatagatcaatttgagattccacaaactgcactcataggatggcaaacttaatttataaatgttgtatgtattctcattgctacactggccagccactctcctgtctctctccctcttcttgggcccccctattccttcaggcacaacaatattgaaattaggccaataaatgaccctgcaatggtcactaagtgtatagtgaaaggaagagtcacatacctctcaatttaaattaaaaaatatatatataaatgattaaacttagtaagaaaggcatgacaaaagctgagatagaccaaaagccagtcctcttatgccaaacagttatccaagttgtgaatgcaaaagaaaagttattgaaggaaattaaagggatactgcaatgaacacataaatgacaagaaagcaaaacagcctaatggctgatataaagaaagtttaagtggtctagaccaaaccagccacgatattcccttaagccaaaacctaatctagagcaaggcatcaactattttaattcttttaagcctgataaatgtaaggatgttgcagaagaaaagtttaagttagcagaagttggttcatgagggaaagaagccatctccataacacgcaagtgcaagtgttgatgtagaacctgcagcaagttatccagaagatcccacgatcattgataaaaatggattcactaaacaacagattttcaatgtagatgaaacagccttctctctctctctctctctctctctctctctctctctatatatatatatatatatatatatatatttatttatttatttatttatttattttgagacagagtttcaccattgtcacccaggctggagggcagtggcccgatcttggctcactgcaacctctgcctccccggttcaagtgattctcctgcctcagcctcccaagtagctaggattacaggctcccttgccacgtctggctaactttttgtgtttttaatagagacagggtttcaccatgttggctagactggtctcaaactcctgaccgcaagtgatccactcaccttggcctcccaaaatgctgggattacaggcatgagccaccgtgtctggctgaaacagccttcttttggaagagcatgtcatcatagagaggataagtcaatgtctgtcttcaaaacttcaaagaacaggctgactatcttgttaggggctaatgcagctggtgactttaagttgaaaccaatgctcatttaccaatccccaaatcctagggcccttaataattattctaactctatgttgtctttgctctctatatagaacatcaaagcctggatgacagtacatacgtttagagcatggtttattgaatattttaagcccactgttgaaacctactgctcaagaaaaatggattcctttcaaaatattcctgctcattgacaatgtgcctggcaactcaagagctgtaatggaaatgtacagggagattaatttattttcaaggctgctcatacaacatccattctgcagcacatggaacaagaagcaattgtgactttcaagtcttatttatttaagaaatacattttgtaagactatagctgccatagatggtaattgttctgatgtgcatgtgtaaagtcaattgaaaaccttctagaaaggattcaccatattagataccattaacaacatttataattcatgggatgaggtcaaaatatcaacattaataggggttagaaataagttagttctaacccttataaatggcttcgatggagtcaagactttactggaggaaatcactaaagatgtgatgtaaatagcaaaagaaatagaattgaaaacgaaacctgataatgtgactgaattgctgcaatctcatgataaaacatgaataatgtggagttgatttttgtggatgagcaaagaaaatggttccttgagatggaatctactcttggtgaagatgttgtgaacatcgttgaaatgacaacaaaggattttgaatattacctggatttagttgagaaagcagtagtatggtttgagaggattaactctgaaagctgcttcactgtgggtaaaatgctatcaaatagcattacataccacaggcaaatctttcatgaaagtaaaagtcaatcaatggggcaacatttattgtcctattttaagaaattgccacaatcactccaaacttcagcaaccaccaccctaagtagtcaacagcagtcaaagactctccaccagcaaaaagattatggctcacggaaggctcagataatcgctagcgttttttagcaatagcatatttttaaaaaggtctatatattttttaggcataatgctattgtatacttaatagaccatggtatagtgtaaacatacattttatgtgcactgagaaacccaaaattcatgtgactcacgttattgcagtggtctgaaaccaaatctgtgctatgtctaaggtatgcctgtattataaccagataaatagacttcattttaatttctcacacctattcataagtatattattatatatgcatagcatttataagcagatatacctgcttaatacagttttaattcagaaaacaaacaaaaagcaaaaaaaaaaaccgaagtaaggatatt

SEQ ID NO: 193 - DNA, 24140 bp, Homo sapiens
aggcctccatgcataaaaaaccactactctgagtttatacattaggtctctaaagaaaccaactcgttaacaaagacaaacttaggaaaccgggctgcaataccagatcactttcaacttgtcctgctcctgtgacttactgtaaggaagctcttaaacaaggtcctgattttataatgtcgtataccttagatatgagaaaatggaaaaaatatgacctaccttatagagtattacagatgattaactgagttatcacagagaatgtacctaatatcacataggataatacatgtccaatagatgtaagtgacaacatgagattaacgaggctgagtcacacctcaatatcatgatgctaggtaattattttctcaatacttccatagagattattagaaatactaatatcaaatatttttccccttagtggtgctccaggagctcagagattccaacagctctaagttccaggtctctgagtttatcctgatgggattccctggcattcacagttggcagcactggctctccctgcccctggctctgctctacctcttagctctcagtgccaacatccttatcctgatcatcatcaacaaagaggcagcactgcaccagcctatgtactatttcctgggcatcttggctatggcagacataggcctggctaccaccatcatgcctaagattttggccatcttatggttcaatgctaagaccatcagtctcctggagtgctttgctcagatgtatgccatacattgctttgtggccatggaatcaagtacctttgtctgcatggctattgatagatatgtagccatttgtcgaccgctacgatatccatcaatcatcactgaatcttttgttttcaaagcaaacgggttcatggcactgagaaacagcctgtgtctcatctcagtgcctctgttggctgcccagaggcattactgctcccagaatcaaattgagcactgtctttgttctaaccttggagtcactagcctatcttgtgatgatcgaagaatcaatagcattaaccaggtccttttggcttggacactcatgggaagtgacctgggtttgattattttatcatatgctctaatactttactctgtcctgaagctgaactctccagaagctgcatccaaggccttaagtacctgcacctcccacctcatcttaatccttttcttctacacagtcatcattgtgatttccattactcgtagtacaggaatgagagttccccttattccagttctacttaatgtgctacacaatgtcattccccctgccctgaaccccatggtatatgcactcaagaacaaggaactcaggcaaggcttatacaaggtacttagactggagtgaagggcacctgatatggaaaagatattcattttttgaaaattttcttcacatgtttttatatcatattctccaactgctgcaaatggcagaacaacaaagaaatagcataatgaattggtggcaacaactgacactttagaacaaaggagatagaagtaatatttgaaatatttgggagtcaagcaaaaatcttcatcacaaagggtaacagtgatgctatttgtctcaaggaattcaaagaaaagactaatgtaatctacatttcatgttcttacccacttgtcttagctaaaacttccagacagtgttgaatagaagtagttagagcagatattgtgtcaatctattccttttaattgaagagcttaatattttacatttgatgtaataattgataaaataggagatacttctgcattttcatgatttgctttattatgtgtcttatatttttaatttgcaaaggacttgaatagacatttctctaagattatatgcaaatgtccaaaaaatacatgaaaagatgctcaacataactagtcattaatcattaggcaaattcaatcaaaaccacaataacacacccctttaccccctatattatacaacaccacaataacacacccctttacccccatattatacatataaatgtactgcaaatttatttttttgcaataagagattagtgtttgcaagtatatggatacactgaaatctcaatacattgttgggaagtaaaaatggcacagtggctgtggaagagtttggcaattactaagaaacttcagtgccattaacatatgacccaggacccaacttttaataatacacccaacataattgaaaaaaatgttaatacaaaaacctgtacacaaatgtttacagtagcattattagccaaaaagtagaaacaacctgtatatctataagctgtgtcttgttctgttttgtgttgttacaacagaatacctaatactgagttagaaatataggtttatttagctcatagttctgcaggcagggtacttcaaggacatgtccctggcttcatctgaggactttggtgttgcctcataacatggcagacaaggtcaaagggaaaacagacatgtgcaaagagacaaaacccaacgggcttcccagctttataacaactcactgtcatgacaaatccatctcccagagaactgatccagttatgtaacagagaaaactcagtaactgccacaagaatagcaccaagtcattcatgaggaatccatccccaggacccaaacatctcttactgggccccacttcccaataccactacagtggggatcaaatttcaacctgatttttggtggagacaagcaaaccctatccacaccatagcagctactgaatggataaacaaaattaagtgtatctatactaggaattattatttaataaaaagtacctatatgagatgatagatatactaatcagcttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaa

SEQ ID NO: 194 - DNA, 28122 bp, Homo sapiens
agcctctatcctatggttgttcatcaattacttaatattatttgacctctagatctcactacctgaattatttttggagtgctttcctcaatattgtacaagtcctagagatacaaattgacagaaaatccctctgaaatttctgtatgtataaaacttaaaaatgtaggaagaggttttgtattgtgcttttccttaaaaaaaaaaaaaacaactttcccaaagccttcctcaaagagaaaattatcataaaatttagatatttaacacttttatgcctatatttaataaaagctagctctaccatacccaaattaagatttttagcaaaatgatgtgacttgttcctaattacatccacgccctagatttgacttgcttcaggctaattgggttttacaaccctagggaatagacttttcctccacttaagcaggtccctgagtttctctgcactggtcataatatcctagtccatcttcagtggctgtaaaccagctctgggtatactgaagatcactacatatgacaagtctttcacaggacaccacagtaagtacatagctggggccagagtcagtctttttaatcttcgcggagatttgggaatgccatatagaagggtaagcctcagctatgatggaggcatctacataatgcttctttaatgactgtgtagaaaccatgaaatacacttcatgtcaaattaatctgaatattggaaaactttatggaacctaatacaacaaaatgttagatatttcataaccactatgtcttaatatgtaaaaataaaagtatattaccaccagcatttttagaatgatatttcttgtttatttattgttttggcatattttattttattagatactttggagctttgtaattcttcacaaaattttttcaagctcaatatttagcttttgtattagacactgtaactctccagctccgttgagtttttatgcatattcctgcacatgtctttcttagcttgctgacacataatacctggtaccagtttcatggtattaggcatcaaaggccctcatttaaatttaccacataaatattaattatcccatcttgcaagaattttaattaggcattttaatagaattgttaacacactccagaatctagaaatgaattattatatttcatagaatagaatcaagaatcctagaggctaagacttttgttgaagttcatagggccacacagaatttcattttcacccaaagtattagaatttttgctgaactgtgagaataatatatttacatgtgtgtctttcaattggaaatactagaattggaaagacagagtctcacatacacctgccaagaagtaatattaatgtttagcaatcatcaatatataaatataatccattgtaagaataaattgtacagttttcttccaagcagtttttcattataaaagatttatcttaaattttcctggtatttcaagctagatcattgtattttctaagatagatgccacatgtattttttttctttactaatctattgaacagtggacccttacttcattgaagaaaaataattgatttactatactctctagcaatttaaacaatttttctctggaggccatgtccaatactattttatatttgattcatttatcgtttaatgcccttgctaaatttttctaaatatatgaatgtcatttgttttttatggctttcgataattttgcatgttgttttatgaaatttatgatattctttgttacttctcactcattacccaaagcatcactgatattcatgcatcttctttatgtatttatgatcggtaatctcttattttttgcaagagatttacatttaactcctttggtacaaatatacagttatatagaatgaataaaacctagtatctgatagatcagtagactgactaaagttaacaataatctattgtacatttcaaaatagctggaagagaataatttaaatgttcctagcatcaaagtatcacatgtacactgaacatctgtacatttatgtattaataaaaaaagacaaaaacaaataattcaagaaaaaatctatatcactgccagtttttgtttacgtatttatttaaagaaatatatttaaatatactttaccataaccatactttgtcattttctactagaatttcaagtttaggttatgtgtttgggatcaggctagtcacaaatactatattatcctgttaatgtttattataatgttattatcatttcacaattattattttaactgaattactaattttatatatgacattgttacattggttttcttatctaagaatacccgatttattctgctttcaaattttgtattaaagtttctttcaaaaatagtacagttttaaaaaatgtaacctgagtctcttttttaattagcaattataatctataagaatcagtatgtttacagatgcatatgaattacctctttcatgttttataatatgtataattttatttttagttttcatcttgtcttgatgagatatccgctatactcttctaccccttgattgtttcaacatgattctcctttcaatccctgtctccttccattacattatatttatttattaatttatttttgagacggagtttcactcttgttgcccaggctggagtgcagtggtaccatctcagctcaccgcaacctccgcctcctgggtttaagcaattctcctacctcagcctcctgagtaactggggctacaggcacacgccaccatgcccggctaatttttgtattttcagtagggacggagtttcaccatgttggccaggatggtctcaatctcttgacctcctgatccgcctgcctggcctcccaaagtgctgggattacaggcgtgagccactgcacctggcctccactatatttttaacgtgcttatatgtcaatagccctaacctcctcataaacaatacaagactcatggacataaaactgcttatttctgcttcagtattcattcacataatataaattgagtgcttattaagtgtctgtctcttggggaaaaacagtgacataaataacaaatatcccacgcctttaggtttctatgggagatacgtatatcaactcaatgacctacacactgatatatatttttccttctttgggcagttagacacaatacagtattccccaagccacattttaattaagcattaaaatttgtagaaacaatttcatcaattaaccttattttgttacaagtagtataagatgttattacctaaagtgaatatatcgaccaagtcaacataacattgcctcctctgtagactctataattttagcgcacaaattttaaaaataattttttgcctttatattgtatccttaatattttaaatacttaaaaggaaagaagaaataaatagtgcagagtagcacaagtaaaacatttcatgaaaatttgttctgaatattttaattcaaatattaacaaaagaatatagaaaggaggtgtcagatacagagagattagatattaggaggccttatgccaaagcattgctctcaaaatcactgatttgcgtgcatgtctatgtttgtgtgtgcatgtgcgtgcatgtttttaacttctacgccagtcatcatggccatatggccattagaatactccaaaaaccaaaaatatacgcaagtagaaataagtaacacaaaactacaaccaactgaatttacagaacactggtatttccaaaccacattaaactctttcatatttgcatgaatttatacacgttattagaatgcttacacatcaattacatgactataaaatgggtatactaacttagctcatacattttaataaaaagtaaataatatacatcaatacttcataaatgtttaagtacgtgaacaaaaaatagttcacttctatatactctatcatcaaatatcttacctaaaaggcctccatgcataaaaaaccactactctgagtttatacattaggtctctaaagaaaccaactcgttaacaaagacaaacttaggaaaccgggctgcaataccagatcactttcaacttgtcctgctcctgtgacttactgtaaggaagctcttaaacaaggtcctgattttataatgtcgtataccttagatatgagaaaatggaaaaaatatgacctaccttatagagtattacagatgattaactgagttatcacagagaatgtacctaatatcacataggataatacatgtccaatagatgtaagtgacaacatgagattaacgaggctgagtcacacctcaatatcatgatgctaggtaattattttctcaatacttccatagagattattagaaatactaatatcaaatatttttccccttagtggtgctccaggagctcagagattccaacagctctaagttccaggtctctgagtttatcctgatgggattccctggcattcacagttggcagcactggctctccctgcccctggctctgctctacctcttagctctcagtgccaacatccttatcctgatcatcatcaacaaagaggcagcactgcaccagcctatgtactatttcctgggcatcttggctatggcagacataggcctggctaccaccatcatgcctaagattttggccatcttatggttcaatgctaagaccatcagtctcctggagtgctttgctcagatgtatgccatacattgctttgtggccatggaatcaagtacctttgtctgcatggctattgatagatatgtagccatttgtcgaccgctacgatatccatcaatcatcactgaatcttttgttttcaaagcaaacgggttcatggcactgagaaacagcctgtgtctcatctcagtgcctctgttggctgcccagaggcattactgctcccagaatcaaattgagcactgtctttgttctaaccttggagtcactagcctatcttgtgatgatcgaagaatcaatagcattaaccaggtccttttggcttggacactcatgggaagtgacctgggtttgattattttatcatatgctctaatactttactctgtcctgaagctgaactctccagaagctgcatccaaggccttaagtacctgcacctcccacctcatcttaatccttttcttctacacagtcatcattgtgatttccattactcgtagtacaggaatgagagttccccttattccagttctacttaatgtgctacacaatgtcattccccctgccctgaaccccatggtatatgcactcaagaacaaggaactcaggcaaggcttatacaaggtacttagactggagtgaagggcacctgatatggaaaagatattcattttttgaaaattttcttcacatgtttttatatcatattctccaactgctgcaaatggcagaacaacaaagaaatagcataatgaattggtggcaacaactgacactttagaacaaaggagatagaagtaatatttgaaatatttgggagtcaagcaaaaatcttcatcacaaagggtaacagtgatgctatttgtctcaaggaattcaaagaaaagactaatgtaatctacatttcatgttcttacccacttgtcttagctaaaacttccagacagtgttgaatagaagtagttagagcagatattgtgtcaatctattccttttaattgaagagcttaatattttacatttgatgtaataattgataaaataggagatacttctgcattttcatgatttgctttattatgtgtcttatatttttaatttgcaaaggacttgaatagacatttctctaagattatatgcaaatgtccaaaaaatacatgaaaagatgctcaacataactagtcattaatcattaggcaaattcaatcaaaaccacaataacacacccctttaccccctatattatacaacaccacaataacacacccctttacccccatattatacatataaatgtactgcaaatttatttttttgcaataagagattagtgtttgcaagtatatggatacactgaaatctcaatacattgttgggaagtaaaaatggcacagtggctgtggaagagtttggcaattactaagaaacttcagtgccattaacatatgacccaggacccaacttttaataatacacccaacataattgaaaaaaatgttaatacaaaaacctgtacacaaatgtttacagtagcattattagccaaaaagtagaaacaacctgtatatctataagctgtgtcttgttctgttttgtgttgttacaacagaatacctaatactgagttagaaatataggtttatttagctcatagttctgcaggcagggtacttcaaggacatgtccctggcttcatctgaggactttggtgttgcctcataacatggcagacaaggtcaaagggaaaacagacatgtgcaaagagacaaaacccaacgggcttcccagctttataacaactcactgtcatgacaaatccatctcccagagaactgatccagttatgtaacagagaaaactcagtaactgccacaagaatagcaccaagtcattcatgaggaatccatccccaggacccaaacatctcttactgggccccacttcccaataccactacagtggggatcaaatttcaacctgatttttggtggagacaagcaaaccctatccacaccatagcagctactgaatggataaacaaaattaagtgtatctatactaggaattattatttaataaaaagtacctatatgagatgatagatatactaatcagcttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaa

SEQ ID NO: 195 - DNA, 33495 bp, Homo sapiens
aggcctccatgcataaaaaaccactactctgagtttatacattaggtctctaaagaaaccaactcgttaacaaagacaaacttaggaaaccgggctgcaataccagatcactttcaacttgtcctgctcctgtgacttactgtaaggaagctcttaaacaaggtcctgattttataatgtcgtataccttagatatgagaaaatggaaaaaatatgacctaccttatagagtattacagatgattaactgagttatcacagagaatgtacctaatatcacataggataatacatgtccaatagatgtaagtgacaacatgagattaacgaggctgagtcacacctcaatatcatgatgctaggtaattattttctcaatacttccatagagattattagaaatactaatatcaaatatttttccccttagtggtgctccaggagctcagagattccaacagctctaagttccaggtctctgagtttatcctgatgggattccctggcattcacagttggcagcactggctctccctgcccctggctctgctctacctcttagctctcagtgccaacatccttatcctgatcatcatcaacaaagaggcagcactgcaccagcctatgtactatttcctgggcatcttggctatggcagacataggcctggctaccaccatcatgcctaagattttggccatcttatggttcaatgctaagaccatcagtctcctggagtgctttgctcagatgtatgccatacattgctttgtggccatggaatcaagtacctttgtctgcatggctattgatagatatgtagccatttgtcgaccgctacgatatccatcaatcatcactgaatcttttgttttcaaagcaaacgggttcatggcactgagaaacagcctgtgtctcatctcagtgcctctgttggctgcccagaggcattactgctcccagaatcaaattgagcactgtctttgttctaaccttggagtcactagcctatcttgtgatgatcgaagaatcaatagcattaaccaggtccttttggcttggacactcatgggaagtgacctgggtttgattattttatcatatgctctaatactttactctgtcctgaagctgaactctccagaagctgcatccaaggccttaagtacctgcacctcccacctcatcttaatccttttcttctacacagtcatcattgtgatttccattactcgtagtacaggaatgagagttccccttattccagttctacttaatgtgctacacaatgtcattccccctgccctgaaccccatggtatatgcactcaagaacaaggaactcaggcaaggcttatacaaggtacttagactggagtgaagggcacctgatatggaaaagatattcattttttgaaaattttcttcacatgtttttatatcatattctccaactgctgcaaatggcagaacaacaaagaaatagcataatgaattggtggcaacaactgacactttagaacaaaggagatagaagtaatatttgaaatatttgggagtcaagcaaaaatcttcatcacaaagggtaacagtgatgctatttgtctcaaggaattcaaagaaaagactaatgtaatctacatttcatgttcttacccacttgtcttagctaaaacttccagacagtgttgaatagaagtagttagagcagatattgtgtcaatctattccttttaattgaagagcttaatattttacatttgatgtaataattgataaaataggagatacttctgcattttcatgatttgctttattatgtgtcttatatttttaatttgcaaaggacttgaatagacatttctctaagattatatgcaaatgtccaaaaaatacatgaaaagatgctcaacataactagtcattaatcattaggcaaattcaatcaaaaccacaataacacacccctttaccccctatattatacaacaccacaataacacacccctttacccccatattatacatataaatgtactgcaaatttatttttttgcaataagagattagtgtttgcaagtatatggatacactgaaatctcaatacattgttgggaagtaaaaatggcacagtggctgtggaagagtttggcaattactaagaaacttcagtgccattaacatatgacccaggacccaacttttaataatacacccaacataattgaaaaaaatgttaatacaaaaacctgtacacaaatgtttacagtagcattattagccaaaaagtagaaacaacctgtatatctataagctgtgtcttgttctgttttgtgttgttacaacagaatacctaatactgagttagaaatataggtttatttagctcatagttctgcaggcagggtacttcaaggacatgtccctggcttcatctgaggactttggtgttgcctcataacatggcagacaaggtcaaagggaaaacagacatgtgcaaagagacaaaacccaacgggcttcccagctttataacaactcactgtcatgacaaatccatctcccagagaactgatccagttatgtaacagagaaaactcagtaactgccacaagaatagcaccaagtcattcatgaggaatccatccccaggacccaaacatctcttactgggccccacttcccaataccactacagtggggatcaaatttcaacctgatttttggtggagacaagcaaaccctatccacaccatagcagctactgaatggataaacaaaattaagtgtatctatactaggaattattatttaataaaaagtacctatatgagatgatagatatactaatcagcttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaaatgacataatgactgttggaagttcattgtatagcagttatagcattgcctctgtgagcaggaaataaaaaaaagagtaatttcaaggagtgactgaccatcagtcttctttcccataatggctattttgttttccttgtagatcaatgactatatttgttctattatgtttaatatgtgatatatacactgtctgggtgtgtgccttaagcattaggtgttgacaggaaaaactgagtctagtcagtacatttggacctgaatatctggggtctttgttatcatgtagtccattctccaggccaacgttggccatgaactgaacaactctgtggtcaagaattgattaaatatttgctctattctaggtgctcaccatcttagagatctccgttgtattctgaaatgttaacagacttcattagttcctgtgggcttacctttcaaattaaatctgtcctaatggacatactgacaatattttcaatctagttttagcccaaactccacccttttggtttgcagaaaacctaaatacagaaaaatatgaatcatccccttgtagctgtagttttcttgaagcgaaatcatagaatgatcttagaggcaaataaataataataataataatccactttctaatatcagcaaaagaccacttgttttataagtaccatgatatatagaggatgaaggatcattaaaaatgcaagaacttatgagaatccaatgttttcctaagattacagtctagtctaattgactctagagtcaattcagtgaaaataaagatgcttatcatcttaaacaaaataaattgacattccctttagaacatagtgctttatattctacccatatcaaaacttcagccatagaatcaaatatttttgaggcttaaaataaagaatatttttatcaaatatttttgaggctatgtaatctccaaaactaagtttcttttgtatacagaagatgttcaatacgtttttcaaggcccacagaagaacaggcagtggtagaacaaggaccaacaaaacacttctgaatagtaagggagagaatatttggtgtgatagtgtgctgtgagaaaataagaacaaactcaaagttatgaccacagaatagatgaaaataggcttcacgggtctgaagaagtgggctatatcagccggaatgtgttgattaaaattttttaaaaggagcaagttgtgtgatgggggcatatcccatatagaaggatattggaggaaaactaagtaggctttctaatttaaaaatatcaatattgatatttatagttcctccttgacatattggaggtgacccacctgtcacttcagggatgtcactattgaaaatttaaggttgtataaaactggctatcctattttcatatgtgtcttttataaaatttttatgtccttattttatgaaatattagggctgtataaatgaactcttgtcacttttctaattgagatataattcaaataacattactatcatgtgaaatagaggcaactcactgaaaagaagacaaaacacagaaaagtatggaatgaggctgtcatctctctttttttcagatcacagaaaaaattcttttctctcagaaatgctgcttttagctttcacagccagagggaataaatagaatacttcctgcaaagattgtttcagtaattgaaatgtgaatattttatccaaagtgaaaatggaacatacaagccagtttgtctgctgcaccattttaaaagctaggagaataactcttctgacaactctcttactcatcctcatttctcagctactgtaatctgcacccatccctttaataagaataaagaaatctcagttcagaaatctgctcaccctaatgatcagtgatgttgagctttttctcatatgattgttggccacatacgtgttttcttctgagatgtgtctgttcatatccctttcctactttttaataggttgtttttttcttctaaatttaagttccttaaagatctggatattagacctttgtcagatacatagtttgcaaaaatgttctcctatcctgtaggctgtctgtttactctgttgatagtttcttttgctgtgcataactcccataggagggagagaatcaggaaaaatatctaatggatactaggcctaatacctgggtgatgaaataatctgtacaacaaacctccatgacacatattaacttatgtaacaaacttccaaatcctgcacatgtaagcctgaacttaaaataaaagcttaaacaaaagtaaatctgcttaccctgaaaactaccggagttcctcaagaaactgaagacctatccatggatcaagtcatatttatgtctatatgatcctcttggtcctgaaggagaaatataatacctacattgagaccttgggaggcaagtggaggagggaacatttctattatctgtccatatgtgtgtgtacgtgcatgcatgcatgtgtgtatgttgtggatgttttatattctgaagttgagtaatggaaaacacttggttgttattgtctctactgtagtctcagaagagaagtgatttccccggtgaatgcatttgtgtatgtgtgtatgtttagaatatgaacaaaagagaattaagaatcaggtatatctgggtcctaaggatactggctaagccagtgggagcagtcttcagaactattttgacgtcattatagtctgggactcctggggacataattttttacaggtacagcagagatacatatgtctgaaaccacttggagtatcataattaaatccttttgagaggcacacctgcctcttttttcaaaacttagcacaatgtcatgcacaaaattagtactgaaaaagatgtttttaaagaaaacttaaataatgccggtatgcaaacaattgagttgtatatgtgaacttttatttcatgtctccaatatatttgcttattatttataacatttttatgaacatgatttggaattatctagacatatttttcactctgtgaaaaatgagtaatttgcttctttctttcctatttgtatgattttttcttgccttattgcactggttaagatcttccttctatgcaatgtttaccaagagtagcaataatgaatatctttgcttcattactaaggactgggtataatgatgcctactgagggtaatgaaacttagttccaaatgattatataaagacctagactaatggtacagtgcagaagcatagctatgccataataaaaaataatatatttcacttaacaatgccctctaggttcatctatgttgttgcttgtgacagaattttctgaattttttaaggccaaatagtattccattgtgtacatattccatatttttaaacccattcattcattgatggacacattttgactattgcaaataatactgcaatgaacacgaggttgcagacatctcattaacatattgatttcaatttctttgagcatatacccagtgagactgctggatcatatggtaattccgtgtttgattttttgaggaacctctatactgttttctaaaagaactatactaatttaaattcccaacaagagtgtataatggttcacttttctcaacattttcatcaacagctcttatctttcatccttttgataatagccaatgtaacaggtgtgaggtaatgtcttattatggttttaatttgcagttctctaaagattagtgatgttgagcatttcctcacatactttttggccacttgtatgtcttcttttgagacatttttattcaagtcctttctctactttttatagggttttttttttggcaattgagtagtttgaattccttgtttattttggatattagtccttatccagcatatgatttgcaaattttttttcaatctgagaagttatctctctattggtatttttggctatacagaagcattttaatataatccaatctcaattgtttatttttgcttttgttgcctggtgcttttggggtcacagtcattaaatctttgcccaaaccaatgtcatggagcttttctcctatgttttcttttattaatttaatgtttcaagttttatatttgaatctttaatttattttgagttgattcttgtataagagacaagctaagggttcatttatattttctgtatgtggatatcaatttttcccaataccatttattgaagacaggtccttttctttttaaatgtgtggtttgcttctgggatctctagcccattccattggtcaatgtatctgtttttatgccagtaccatgctgttctgattactatagctttgcaatatattttgaaattctgtagtgtggtgtctccagctttattctttttggtcaatattgctttgactaattaaggtcttttatagttccatagaaattttaagatttttttccatttctgtgaagaatgacattggaatttttatagagattgcattgaatctgcagattgctttgggctttatagacattttaagaatattaattcttccagtccatgaacacgagatatcattccatttatttatgtcatcttcaatttctcttttttaacttttattttagatttggtggtacttatatttctaattttatactgttactatattttattgattgtcatagcattataatacatttttaaattagtgtaagcactgtcaattaggtccttctttaaaaagattctttggatatcctttgtcctttgcatttccatagataatttagaattaattgtgtaatttctacaaaaagctgtcttggatttttgtgaagacaatattgaacctatagatcaatttgagattccacaaactgcactcataggatggcaaacttaatttataaatgttgtatgtattctcattgctacactggccagccactctcctgtctctctccctcttcttgggcccccctattccttcaggcacaacaatattgaaattaggccaataaatgaccctgcaatggtcactaagtgtatagtgaaaggaagagtcacatacctctcaatttaaattaaaaaatatatatataaatgattaaacttagtaagaaaggcatgacaaaagctgagatagaccaaaagccagtcctcttatgccaaacagttatccaagttgtgaatgcaaaagaaaagttattgaaggaaattaaagggatactgcaatgaacacataaatgacaagaaagcaaaacagcctaatggctgatataaagaaagtttaagtggtctagaccaaaccagccacgatattcccttaagccaaaacctaatctagagcaaggcatcaactattttaattcttttaagcctgataaatgtaaggatgttgcagaagaaaagtttaagttagcagaagttggttcatgagggaaagaagccatctccataacacgcaagtgcaagtgttgatgtagaacctgcagcaagttatccagaagatcccacgatcattgataaaaatggattcactaaacaacagattttcaatgtagatgaaacagccttctctctctctctctctctctctctctctctctctctatatatatatatatatatatatatatatttatttatttatttatttatttattttgagacagagtttcaccattgtcacccaggctggagggcagtggcccgatcttggctcactgcaacctctgcctccccggttcaagtgattctcctgcctcagcctcccaagtagctaggattacaggctcccttgccacgtctggctaactttttgtgtttttaatagagacagggtttcaccatgttggctagactggtctcaaactcctgaccgcaagtgatccactcaccttggcctcccaaaatgctgggattacaggcatgagccaccgtgtctggctgaaacagccttcttttggaagagcatgtcatcatagagaggataagtcaatgtctgtcttcaaaacttcaaagaacaggctgactatcttgttaggggctaatgcagctggtgactttaagttgaaaccaatgctcatttaccaatccccaaatcctagggcccttaataattattctaactctatgttgtctttgctctctatatagaacatcaaagcctggatgacagtacatacgtttagagcatggtttattgaatattttaagcccactgttgaaacctactgctcaagaaaaatggattcctttcaaaatattcctgctcattgacaatgtgcctggcaactcaagagctgtaatggaaatgtacagggagattaatttattttcaaggctgctcatacaacatccattctgcagcacatggaacaagaagcaattgtgactttcaagtcttatttatttaagaaatacattttgtaagactatagctgccatagatggtaattgttctgatgtgcatgtgtaaagtcaattgaaaaccttctagaaaggattcaccatattagataccattaacaacatttataattcatgggatgaggtcaaaatatcaacattaataggggttagaaataagttagttctaacccttataaatggcttcgatggagtcaagactttactggaggaaatcactaaagatgtgatgtaaatagcaaaagaaatagaattgaaaacgaaacctgataatgtgactgaattgctgcaatctcatgataaaacatgaataatgtggagttgatttttgtggatgagcaaagaaaatggttccttgagatggaatctactcttggtgaagatgttgtgaacatcgttgaaatgacaacaaaggattttgaatattacctggatttagttgagaaagcagtagtatggtttgagaggattaactctgaaagctgcttcactgtgggtaaaatgctatcaaatagcattacataccacaggcaaatctttcatgaaagtaaaagtcaatcaatggggcaacatttattgtcctattttaagaaattgccacaatcactccaaacttcagcaaccaccaccctaagtagtcaacagcagtcaaagactctccaccagcaaaaagattatggctcacggaaggctcagataatcgctagcgttttttagcaatagcatatttttaaaaaggtctatatattttttaggcataatgctattgtatacttaatagaccatggtatagtgtaaacatacattttatgtgcactgagaaacccaaaattcatgtgactcacgttattgcagtggtctgaaaccaaatctgtgctatgtctaaggtatgcctgtattataaccagataaatagacttcattttaatttctcacacctattcataagtatattattatatatgcatagcatttataagcagatatacctgcttaatacagttttaattcagaaaacaaacaaaaagcaaaaaaaaaaaccgaagtaaggatatttttcaaagattttctgacttgaggaactttgtagcagagtctaggacttgaagcattacctagcatctgatagcttactatttatttaagtattattttaaaaatgctattaatattgtaactcagcaagttttaaaaggaaagctgacatctatgtttttcatttattagctatctgctctggaataaagctacacaccaccatattgttaataattgaagactcactctgggctgaagctctatggcatagagcttattttatgtgtttcggtaagcgagctggctcactgaaaaagaaaaaaggacctacatttgtggggattctgtccatcgtagctgcttgtgctagaagaaagatgtgccattacatcatattactgtttaccgttttctcctctccatagactgcattcattctacaaacccaaggtattaaattgtggtcacgatgttctttgattcctttccagacatctgtctactttgaggataatttcaatcccagcctttgatgtttccttaaacttgatcaagatgtactaacggggattgcaacagaaaagaatgctatatttctactgaagtaaaggggaacagtgatggagagacagtgcatttaacagtgttaacctttcaaataaagacataactcagccttattgcagaatatatattttaatgagcccctagcataaaacattctgaaattgtttactcaatatttttgagaaagctttaaaatacccacatggcacatgaataaatatataaaatgttatgaaactggaatggaactgccctagggagtcaggtaaaattccaggtttatgattcaatagatgctagacacttcacatgtcccatcaataataaaatttgagatttttttctgtcaggcatagacatattctaattatagatctattttcaacaaaggtaaattcacctccttttcagagacctatgggacatctatctgtaaagccccaaagaatttttttaccttggcttggaaaatccccagagaagatattaagtttgttacatagggttcctcatcaatattgtgcaattatttctaagtaatatcagtcatgaatgggaatttaaaaacatctggcaccagggtgagtttggatgaaaatggttcagataaaaagaaaacaaatatataaaatgcacaaaattgctactatataggagggatttaaatgagagagcagttgaataaggaagttctgaattacttcactctttagaattttgaaaccaaggaatttgcaaattgccttgaggagggagaagagggagaaaattaaatgtagtttaggtcctgaaggaaggggattccatgaggctgatgtgacaaggaccaaagagatataggcaagcatatttctatacaataatagaaaaacttctctgccctccatagatggaagagtattcctcaggaagcagtaacatctctaccattgaaaatgaattagtgtaagagttaggatggagggtgggaagacggaaaagatcagaaaaaataactaatgggtactagacttattacctgagtgatgaaataatctccacaacaaacccccatgacaaaaatttaactatggaacaaacctgcacttgtatccctgaacttaaaagttaaaaaaaagaacacttggaagaaattctagtgatcatgtagcccaagttcttgacgacattaatgacatatgccgttttcccactgcttgatacctcagatggcagtgatcccattatcttattagaaaattttatctgtgtgaatgggcaacattcctcaaagccaaatttacatttctgtaacatttttctatttataatat

SEQ ID NO: 196 - DNA, 21287 bp, Homo sapiens
cttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaa

SEQ ID NO: 197 - DNA, 22582 bp, Homo sapiens
tcaagcaaaaatcttcatcacaaagggtaacagtgatgctatttgtctcaaggaattcaaagaaaagactaatgtaatctacatttcatgttcttacccacttgtcttagctaaaacttccagacagtgttgaatagaagtagttagagcagatattgtgtcaatctattccttttaattgaagagcttaatattttacatttgatgtaataattgataaaataggagatacttctgcattttcatgatttgctttattatgtgtcttatatttttaatttgcaaaggacttgaatagacatttctctaagattatatgcaaatgtccaaaaaatacatgaaaagatgctcaacataactagtcattaatcattaggcaaattcaatcaaaaccacaataacacacccctttaccccctatattatacaacaccacaataacacacccctttacccccatattatacatataaatgtactgcaaatttatttttttgcaataagagattagtgtttgcaagtatatggatacactgaaatctcaatacattgttgggaagtaaaaatggcacagtggctgtggaagagtttggcaattactaagaaacttcagtgccattaacatatgacccaggacccaacttttaataatacacccaacataattgaaaaaaatgttaatacaaaaacctgtacacaaatgtttacagtagcattattagccaaaaagtagaaacaacctgtatatctataagctgtgtcttgttctgttttgtgttgttacaacagaatacctaatactgagttagaaatataggtttatttagctcatagttctgcaggcagggtacttcaaggacatgtccctggcttcatctgaggactttggtgttgcctcataacatggcagacaaggtcaaagggaaaacagacatgtgcaaagagacaaaacccaacgggcttcccagctttataacaactcactgtcatgacaaatccatctcccagagaactgatccagttatgtaacagagaaaactcagtaactgccacaagaatagcaccaagtcattcatgaggaatccatccccaggacccaaacatctcttactgggccccacttcccaataccactacagtggggatcaaatttcaacctgatttttggtggagacaagcaaaccctatccacaccatagcagctactgaatggataaacaaaattaagtgtatctatactaggaattattatttaataaaaagtacctatatgagatgatagatatactaatcagcttcactataataattattttgctgtctctatcccataatttcatgctgtaaatctcaaatatatatagaataaaacttatcttacaaaaattcaacttgattgaattaaaaattgctaaatttaacaaaatgacatggaaaattttgtatagtaaagaggaaaaatataaaaagaataaattctcccaacaacaaacaaacaaaagtaaatgaagtactcgtacaatctgcagcatacatgaactttgaaaacattatgcttaggttagtgaagaaagccaaacacaaaaggccacctagtatctgattccatttgtatgaatatccagaataggttaagtctatagaaaaaaaaagcaaattagttgttagtagggaatggagactccaggcaataatgagagactaactaatagttatgaagtttccttttgaggtaatggaaatattgtgaaattagatagtggcaatggttgcacagcataatgaatgtagtgaaagtcacccaattgtacgttttcttttttcattttatataaaattaaggggtacaactgctttttgatacatggatgtatatccatgtatagcctggctgtggtgaagtctgggcttgtagtgtacccaccatagtgggtaccaccagcatagtgtatattgtacctactaaggaatttctcattcctcattccccttccatctgcccatcccccaaatctccaatatttatctatttcacactctatgcctatgtgtacacattaggtagttcccacttaaaagtgagaacatgtggtatttgcttttctgtttctgagatatttcacttaaaataatggcctcataatctatgcacgttgctgcaaaaaacattatttcatttgttttcttgactgaggagtattccattgtatatcataccacattttttttatccagtcatctgttgatggacacaggttgattccgtatctttccctgtgataaacatactagtgccaatatttttaagtgtaattattttaaatgcaattatcttcttttgggtagatacctaggattggcattgctggatggaatggtagttctagttttagtttcttgaatatttccgtactgttttccatagaggtcgtactaatttacattcaatataaaacaatataaaaaactgcaaaaattattctctacatgtatatttgttatataactttctgtaaattaaaagaacatagatgtctgagaacaggaaaatacttaaggaagtgtgtaaaacacataatgtgcctttatttaatcataatactgaacaatccttttttgaatgtgcttaatataaacattaactgaaaatgatagaatttttgtttaaaatttgatgttatccaaacgtttgtcaaaagtatatatagaaattgtatataaaagaaaaagtatcagaagttacctctacattatagaattaggttctaattatctctgtgatgtcctcatttttatttttacacttaataaaaacaaacatttttcttctaaataaaaatacataaaattagattaattattgtcttttattattgcgtttatttgcatcactattattatctcaaaattaaggcatctatttattgctagtttaatatttatatgtaataagtctgaacttttgattaatttttacaattccataatattcatcaccaatcttccttggaaataaattgcttgaaaaccaaggcccatgttttctgatgcttttttcaaagttcctagactaactctgagagtatgaagcactcaatgatgttacttaatacatgaaaacataaaaaaaggaagatgcaaagttgtctgtgtgagcaattaacacattctgtgcttgcttccaatttgtatgccacaaggccttaagcaaaaagaaacaactctgcaatcttattaataacataatttttaaaataaaaacatcctgtgttctttctcgcttccccccacatatacatggccacacataagcacatgtacagatacattcataggaaagtattcactagttacttatgaggcatcatataggtgatgagcatggagtgtttccaccctttcatctcctgtgagcgttgtcttaattccaacactgtgaccctaattatatgaaatatccccttgggacatataacacataattttctttaaaggctcatatcagtagtaaaggtatcaagggattttaatgttggggggagtacatgtacatatattgtaggattctcatgtgttctttgaccaagattctgaacatctgggccaaactgcattcagctcattctattggcatctggaaattaggtattaaaggacataaaaaggagacaggggtagtgacaggatttttcttgttgtagttcatagtagataaattggagagatgttttgccaaagtgtacagaatctttgagtgtatactattattattctcagaaattcagacttgatttcatccacttagtttgaaggtagaagtgttgcagacatttgttttgcagaatgtttatttccccaattttcaggttttcattcagcgaaatttttatgatgattttgaatatttataaacaaagcaaacaggaatcattggaaatgatgaaagtcaggtatgaaccacccgacaacatggagaaaaaatagaaaacagttcttgattatggtcagaattcttccataatcaagttcttacctgccctcctcttgttccttagaataagaatctaattaactggctttattcctagacagacatagttgtgactgtgtttcattgattttggacagcaaacatacttggatgaacctacagtcattttgagaaaagagcatggtctgtaaagactgagcatggtcaagtgaggaaacaaagttactatttacagagtttggggtgaaaatgcacaaccgatgatatcaaaatcatactttataaatggtggtatttgtttttaatgttatcacttaatagacctactcactcacagcataatacaaatctattattcttgcagaattataaagtaatatagtattaaaagcattttataagcttatatttcttgatgagactcatcactttttaaaaaaagttgtggccctcagcttcaaatcctgataatcgggaactcagcgtattggggactagaaggtattataatttccctttttcataaaatataaagctgaattatctttctttcatcaccagcaattagatagatttgtgtaaatttacattgccacagcagtcacattgcccagctgagtttccagcaagtataaatatcattctcagaggcaatttatagtacagttcaaacagacatctttctcaatcgaaatctctttccctttgactctcgggaagcacaaattagagaaatacagaaagcggcatgtaagataaaattaaaatgtagctgctgtattaaaagaagagagaattaacaaagtaaaataaatttttgctaactttaaaaaaagcgtttttaatttgttttggagaaagtattatataacttgtgcttagtgctatattattttgtatcagcaagatctttaactgagatgcttataaatgtaattgagatgagaactaaacttctcatgtaacaataaagccagttttagtaattaaaactatataaaaaggaaacacaagagacataaataggatatttatgtgtttcccttttatagttacagttttaatatatattaatataaggtatattaaatatatgagatataatgtaatatatattaaatatataatgtgagatattatatatgtaacataagataaatatgcaatgtgagataaagacagcataactcatcctaaagatatattttttattttcaacctagaggtatctttacgttctctaatttctctacttgcttctgttacagacatatagagttaagagttgactgcttaaatgaatcgatcaggaaaagcaagcaataattcaatatttttcaaatatttatgagaacttggcatatattagtcaaatatttatcaaactacattagaaaatctagcttattttcacagtaatctatacaattatgtatgtatgtgtataaattattaatttagtttctttaataataaattgtaaaggaaatttgaaaaatagaatacacaaacatgaagaacaaatttacaagcttcacagaaagaaaattgataattttgttatacaaggaaacactttctcattttgtaagcacatatttttcttataaccagaatactaattacaaagcttttcttagccttgaaattatttgtgtaaatccataccagtgttgctaagtcgaaaattgaagatcagccaagaagttgtgttaatgtaagtggattccccattttaaaattttcattgtgtactaataatgtgagaaaaataacttcagtgttttccattattttgcttgagggaaactgtgtcagacaggaaaatgaaacaatttggttcaatcagtttgatttttttttaattttcaattttttgtgggtacatattacatgtatatatttatggggtatatgagatgtttttatacaggcatgcaatgcataataatcacatcatggaggatgggttatccattcctacaagcatttatctttggtgttacaaacaatctaattatactactcattcttaaatgtacaattaagttattattgactatagtcaccctgttgtgctatcaaatactaggtcttattcattctttataacttttttttttgtactcattaaccatcaccaccttccccgccagctcccaccccaacccactacccttcccggcctctagtaattatccttctattctctatgatcatgagttcaattgttttggtttttagataccacaaataagtgagaacatgtgatgtttgtctttcttgcctgaacataattattatggtattttacttcacataataatctccagttccatccctgttgttgcaaatgacaggatctcattctttactgtggctgaatagtactccaccgtgtatatgtaccaaattttctttatccattcatctgttgatggacacaggttgcttccaaatcttggctattctgaacagtgctgcaatcagctttaattgcatggtgtcatgcatttcatctattgtttatcgaaagttgtctctacccagtacttactttctttggtttctactttgactttaatatttcctcaaaaaattttggggaaggtttttagtatgtttagtttctatttctatgaaactctttgtgcatatattgtatatagttttgcctttgtacttttttattgcatatgtatgtatgtatgtgtatgtatgtatatgtgtgtgtatataaatatattttatatatatatattttatatatatatatatatcctagccctgtgaaataggatcaacttgtggtagagattaaataattaacctttacctcccaaaccaaaatatttgtttggtttgccaccttatttacttatttatttattttaccttttggggttatcctttgttttccctaggatttttccaggaatattttttacaacattattaatcaaaaagtagaaatgacgtatatatccatcgattgctgaaaggataagcaaaataaagtatacccataaaaggaattattatggaattattattctgtcaccagaagaagtgaagtatggtacatgttgcaacatatataactattgaaaacatattaagtgaaaaagttagactcagttgcccatctcttgtgtgattccatttatatgaatacctacaatagtccatagaaacagaaagcaaatgaattgctgtcagagccaagggggacaggatgataaggacagactgactaatggttacggagtttccttttgagatgatgaaagtattctgggcttacatacaggtgatggttgcacagcattgtaaccatatttaaagccactcaattgtacacttaattttattatttttaaattttgtggatgcatagtaggtatttattatttgataaatgagatgttttgctctagacatgcagtgtgagataagcacatcatggagaatggggtatccattccttcaagtatttatcctttgagtgacaatccaattcactatttaagttattaaaaaatgtacaattattattgataatagtcactgtgttgtgctatcaaatagtaacttttattcattctttctatttttgtacccattctttctattttttaattcattctttctaactattttttgtactgtctccacctcccatgcccagaccttcactacacttgccagcctctggtaaccgtccttctactgtgtccatgagttcaattgctttgattttagatcccactaataagtaagaatatgagatgtttgtctttctgtgccgggcttacatcacttaacataatgatctccagttccatctatgttgttgcaaatgacagtatcactttttttttatggtagaatagtatcccactgtgcatatgtaacacattttattttatttatccattcatctattgatgatcaaaagaaaggaaatcagtatatattgaagggatatctgcactcttatgtttgttgcagcaccgtttacaacagctaagatttggaagcaacctaagtgtcaactgtatatttttaaaatggttagaaaggttaattttatgttatgtagcttctatcacaaaaaagaaaaagttgtatttaaaatgttctctacatatatatttgttgcatcacttcttgtaaaataaaaatccacagatgtctaagaataggaaagtggttacataaatcgtgtaaatatattggtgtattttttatatattagtaagagaatgaaactgaaaaaggcaaataatgccttagtattactatgaaaattgttgtgacttcatatgtctacacaaatgaacatgaagccctcaacaatccatggataacacctcaacaactgttgcattagatattccagaggtaaaagtggagggaacaggtgataaatcactaatgagcagtgagccaggaaagagatatacaacttagagattatagtggagaaagtatattcaagacttttttacacatccggtagttgtgagctttatgtattaaggtatgaatattcttaataggctattttattcaatagagaaaatgtcataaaattagtaaatgactgatcaaaaataaatcaatatttaaaaacagtatgtgttttgagtcatattctgcatttattatttttgaggcctaacatgtatattatatgtattccttattccctgagtaaattggcctgcagaccgttttacaatatgacatttactaaaggccattttcaataaatccatgaatgctatttttacctgtatattatcagcataattctttttcttttttttttttttttgagaaggagtttcactcttgttgcctaggctggagtgtggtgtcacaatcttggctcactgcaacctccacttcctggattcaagcaattctcctgcttaagcctcccaagtaactgggattgcaggcgcccaccaccatgcccagctaagtttttgtatttttagtagagacggggtttcatcatgttggtcaggctggtctcgaactcctgacctcaggtgatccacctgcctcgccctcccaaagtgctgggattacaggcatgagccactgtgcccagcccagcataatcttttattcaaccatgagcaaatatgtacctgcttttaatacctcttctgttatatttgctgatttacaaaatttttaagataataggtacataaatatttcattataaaggtttttataaatggaatacatttagctggaaggaattataccaccaggcaagaaatagccttggtgaagaaaaaaacagaactctttgtctccctagtaaatagggtttttttttcatgatttatattctggtttaaataccatctctctgtgactctcttactctctcaaggttagaggatcattttctgtgctgtttcagcacttgtgcaaactctcttataaagctcctctaaactatagtttaattgaatgtatatgtttacttgagagattaaattttcatttactcttttattcatctcctactaaaatgttccagttaacatgatcactccttttcttttttagtttgaatagactatttgactctatcaccctgctttccgttaagatgattagcatagcactgaattcaacacatttttattaatatttcaccccttagctagactgtgggcttctttgtaacaaggagaatgtttatatttttctaatggttaatatctaacataaggcctaactaatgtagactcattcatctagtcatttaatgaatatttgttttatttatacctttgagttgcattttgtcagagcctgaaatacaaagacaaatacatacctagtgctttcaaatacaacatgttgtagtatacaatgaacagatgtgtaaacaaataaacttattataagagtgttgtgataatatagtgtgtgtgacaaccaggaagaggtaatgataagttctattttaagatttagctgagttgataaaaatattcagaaatatgggaaatgaaataactaacaaatgaagcatgaatgaatgaatcagtgaatcaatgatttaatcaatcatttcaccaattggttgacatttaactgggaaagccataccatataccaactagctcctgcactgacttctggtgtacgcaagccttgaggtaaataagacttgtctgtccattctaatatatacataaaaatatttctcaaaattaattcataaacctaattttagcttcaaagactgactgggctggaaaatgttctataggaaagattatcaacatagacaagacacttaaggactctttcaaagtttaagaatatatccaagatgaatatattagataaaagttgtgtgaattcataccaacgacttgattaaaacgggcaatgtaacttttgtctttctgtggctggcttatttcatttaacatgctaatttccagcttcatccatgatgctgcaaattacagaatttcatcattttttatgatgccacattttctttatccacttctctgttgatggacacaggttgatttcatgtcttggctattgtgaacaatgttgcaacaaacatgggagtgcaggtatctggtatctcttcaacatattgtttttctttttttggatatatattgttgttctcatttatatgtgggagctaaaaaggtggatctcaaggagatagagagtagactggtggttaccagatgctgggaatggtgggaggaagagaggatgaaaagaggttaattaataggtactaaaatacagttaaaaagaataagacatagtgttcaatagtacagtggataactgtagttaacaataatttattacgtgtttcaacatggctcaaagagaatttgaatgtttccaataaaaagaaaagataaatgtttgaggtgatggatattctaattaccttgattgaattattacacattttatgcatgtatcaaaatatcatttgcacctcccaaatgtgtaaaactattatgtatcaatttaaaaaatttagaaaaataacacgtgatttttaaaaaaacaccattctactttttacttctatgaattgaactagttttagccattctgtaaggtttatatatatttaaaacattatgttatatatgacatatttaactttatgtgtcaatttaaataaattgagttaaactcattttttaaaaactggcaatagacaaaaattaagggaaaggcactgagatatacatccagaatgggctataaatttccccaaaacagtttcagaaaacatagactgagagagaaaatgtatgatactacacatgaataaatgtaaaatatcacacgtaagtttattctttgttatttttcatttatctttcttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaaggaattatgaaacaaatttcattcaaattttccttgcaaatacaaattcaaatttagaataaaattaagtttataatggcaccaacaattatacataagtgactatgaaaatatacaatgtattgaataatactgtattccagataacattttaaaagtttcataaacagtctaaatgtaattccatagccataagtaaaaagttgtattttttttaccacaaaataaaagtagaaactggggcgcagaaagattgaataatattaaatgtcacacaactagattcaggaacagaaacagtattcatatatgacttcaacattcatgcagtctttttactgtgcatcccggcttcacagaggacatatcctatgacagcatgtgaagcacggtccaaaatttcttcagtaaattaatgttgtgtgccaatacacaataggaagattatggttatttctaccaaatagcacattattcatatttcagttttttctatactaactgtgtgacttgataagctttatgtcactctccaagcctcagttgctcatcttaaatgggaagcaggtgatacctacctcaaagagttctgaaaaataatcagaaatttatttactcttaggttaatattctgatggattagatatgctgattattcaaaatgcaggtatagattcaaaatggatataaaatacaggactaatgaccataaatgtcaatctgatttgatggttacaagaaggaagaagaaagaaacctctttttctcaagtaccctataatccttcaatgtcattgagattatctattttctttccatatcttctctttttatataattctcaagaagcatattatctagactctcactttattctctttttgggaaatgtttttactcttatgacctcaagtataaccaacatgaagataattttcagataattacttgtataaataagttatgccacagctgttgagtccttctaaatgcatgacgactattttcatcagaaatatccataaaattttacatttattatgtctaagactacacttattgctttaatctctacctgtgcccaaaatagactttacctctaagttctgtcttttggataatggtgtcattatctactacaatacctaaactagtgtatttatgatcttccctggtatttctccacctcatcttggatataattcatttacagctcaaagggtccaaattgttactccacccaggtcacatcaacatatctattttctgtagtctatcttcagaaaaaaaacttttaaatcagaaaatttcttatatcagctctttctttctaacaccactttcagcgtaaagaccacctagccacatccatttatttcttggcattgcctctttagtatttcataagtgaaatttttcctgtagtacaattttgaagatgttttaatccactgcttaataatcttcaatgtcttcccattactttgagaacagggctcaaattccttggtatgacatttaataaaaggaaatttaggtcttatcttttctttcctgttttatttctttccattttctaaccacttataagtatcctggcttaaacaatgcattatatagtcaatgtagtttagcatttcgggtttaaatacttgctaatcccccccagatacatatacttaaagtctatgttgacttttctcaatttctttcatttatttgcaaatatctctgcaaagtaaagaatattatagctgaagtaaattagagactagaaaaataatagaaaagattgacaaaaataagagtaactttcctgaaaacacaaaatgaaaattaacaaacatttagctagattaactgaggggggaaaaaagagaaaactcaaataaataaaatgaaaatgaaaaaggagacattacaactgatacaacagacatacaaaggttcataagagactactatgaacaattatacaccaataaattgaataatgtagaaaaaatggattatttgactcagtaacataccaagactgaaagatgaaacagaaaagaaagcccagaaaaaagcccatatatctacagccaaaaaattttcagcaaaggtgccaagaacacacaatcaggaaagacagtgtcttcaataaatggtgttgggaaaactgaatatccacactcagaagaaaaaaattagacccttatctcataccacatacaaaaatcaacttaaaatagattaaagacttaaatgcctgatgcttatcttagtaacactgagataggatgttactttctttgaagaagactgtggtttccagagtccagaatgagctattgccgttaaacaccctgatttagatacaggatgtttaacttgcttaatcaaggctattagtgattaactcagaatgaaacataggtttccttagatcagactttcacatatgctccattaaagcaaatcccttataaacagaattaatgcagaagttgtggactaacatgtagtagttcagtgatttattttctcatttgtttgattttgtatttgttttcctatttctttgttttccctgtagcaagatgaggcttcatgtttctagcatgtgacctctaatgctcctgcttcttaaaatttcttccttgtccagcattgcagtcattgtgaaggtaaatagtaagaaagttgtgtgggatgatttatatttttttctttcaaaggagaaggtaatttggttacaaatactatgcggactcaccctgagcctacccgacttctttattcttgcttgtggttctggggaattaaaaaaggcaacagaatgtaggcacgcatttgaggtataataataacaaaacataccacatcaagatatgctgcagcttacgaccttgtgtcaatcacaattgcttgtccatccttgatgacaatgagttccattacctgatgtagatgtccacgcctccagtatctggtgaagggtggagtgattgatcctatcactgttgcatcctgtgcggcctcctcatcccacgctgggcagccatttgacacaaaatacatgtagcatccatggttgcctctggctgtttacaacagaaaacaggctcctttgaattaccactttatcctaacctccagaaaatgtggatgaatcaggaactgcttagaagttaggaaagccaaggagacttactttttcacttccttttaacttccacgctatacttctctagtgatggcttggaacagtattttttcaaggaattcaggaaccagtacacagaataaaatcctatcaggcatctgaacgacctatccttgattctctggagaggaatgtcaggataaagctggatccagaaaagagacttctagattctcttatgctattttatcttttctgttgttgctctaaaatgttttcccagaaatgtcaaatcaaccttttaatgacacaaaatgctgtaattgaatctgaatgtctcaagtgtatggactccaaattaaactgaacatatttcatttgtaaaattaaaaaatatatatatattatcgactgtatctgtgccaggcaatgtatcctttggcacttagcagaaggactttctccatctctactctggtgtttttaggtttaccttgcacataaatagcagatttgcatatcaactccaatatttatccacacgactagacaaaaaaaagtaatagtagtactatttgattgtctatatttacctgtttaatatatttgcttaatatttgaattaactggtgaatttaatcacactcttataatgcatctgctaattaaatagtatctaatcactatctaatcaagactctttgttcaatagcttgccaaagatacagaattttgtgctgtctacactaaatactggtgaggcacaaccccatctctcttaaaccaaaccagaattattatttgaaattcacctttcttcctccttgctaccttcacattttctccatttttatgatgatgataacttgggcaccagtgctcaaacaatttatatttatcctgtctccttactgacctgtgagctcttttagtctatgggccaaatctgccacctattttatcccatgaaaaaggacagtacccagcttaaaaaaagaatactcaacaaattggagttgtattgactgactccaagttgtatgacccaacttaagaaaagggagggactgggaaaggatgggctagtgacttgaagggaaaagtttgtagctatttgttttttcctgatttaagagacagtaaagttcttactgtccacttctctgaccctggcattacagcacatattaaaaaaaagaagaagaataaatataacgagaggagttccttaaattctaaaggagattttgagggcatctaacctgtaccttgtccaccaagaacacatatcccttacaagtactatctctgctttgaatgtggaatgaacatactcttcctaattttctcagactaagaaatcaccaacaacattttctgcaagtcagtgtctttgatccttatgatgacacaaactggctagaacaagacaaggctttgtcacacaataatgtctggaaggcagaaatctcttacccacaatatagctcctgaggagaagtgatgtgaaaggtgttcatgccagggagagggcccaggaatgcatgtgatggcaggaccctggcttcagcttatagagtttggatcagaagtgcttagtccagccgagttcccacaggaaacaggcataatctcatatgctcgagagtctcagtgtgaaactgggcttcggagaccccagagaccacagagccctaagggaaagattcctatatgtgagggaaaaaacttctgtgactatagctgggctccaaaaaagagcagtcaggaaagcaaatcccatgccacagctatcccaccattaggactagaagttggcaattcgtgtctaaggcaattaaaaataaataaaagatgtatatgagtgtgatatcataagtgtgttgttatttattattgttaattctaaaatagtaaatgcttattagtcgaaaaagaaaaaagtaacaataaaggcacttctgaatagtacatacttcagatactcagaaacacttgctattaggattttgtgtgtttttatttccaggtatgtgtaaattttttttgaaaatcacagttttcagaatattcatagtttagaggatattttatcacggttttttccattatgtcatgaatatttcactctttcactcctctgcaatatgtcaaagtcagcaaagctactttatggctataaactttcctttacgtatttttaaaatttaaaacattgagttaatttccaatatgttacaacttgatggtgaacatcaacacaatcatgattaattccattggaaaatttatagacctgaatagatattgagtaaaaaatatgctaattttaaagcttttatgttgctagacttttatccccccagaaagattgcaccaaaactctactgtatgctcttgaacacaatccaagtatatatgccaccttattcagtaaggttctctatgagtaactggtctcccccagctataggtgccagataatggaaagtaaaatagaacaggccataagtagatgtaagtgggaccaaccttacccatagtcagaattgagggtcattgttacgttggatttcttggtgtgctgaaattacgatttaacttcccgataaactacctttctgagcgtgaagattttctacttaacattcagtaatttcagggccagctgtggtggctcacacctgtaaccccagcactttgggaggcggaggcgggcagatggcttgaggtcaggaattcaggaccagcctggccaacatggtgaaacctcagatctactaaaaatacaaaattagcagggcgtggtggcaggcacctgtaatcccagctactcggaaggctgaggcaggagaattgcttgaacctgggaggcagaggttgcagtgagccaagactgcaccattgcactctagcctgggcgacaagcaaggctccgtctccagaaaaaaaaaaaaaaaattcagtaattttgataagcattgtagtttctcagcctccactttttaaatatgaacaaacaagttatcagtaacctagtttattcaaatcattttctttaattattcattcaagaaaataactatcaagaaaattaaaagaaagatgcagttatgagctaaaataaagcagaggactatctgtattcctcctggcaagtgtgtcaataggtgaatggataaagaaaacatcatatatatatatataatagaatattatttaaccttcaaaagaaagaaattctaccatttataacaacatggatgaacctggaaaactaagtgaaataagccaggcatagaaagataaatacttcattatctcacttacatgtagaatttttaaaaagccaaattcatagaaacagagagaagggtggaaacagattagaagcatgttagggggtgagggaaatgaagagatggtggccaaaaaatataagcttacagttatcaaatgagtacattataaagacataatgtgcagtatggtgactagagttaataataatgcattgtatattgaaatttgcataaaaagtaggtcacatattctcacagttgtatgtccgggtttgagtcttctatcaacaattcttctaggtattttggcatttcttggtatttcttaaaaatcacattttgaatttggttcttaaaaattatttcatagtggttgggataaattattctttgctttagcagttttctcttttaatagcaatcataaagtcagacatttgacatcctgaggagatgatctatatcattacttttatgttttacattgccttgcctttttcgtgtcctttttgtgagattttcacaactttatatttcttttcttggatatttttgctatcattccttcttctctgttataaatgttattttctaattgtctataactcctttccttttttgattggtccaaaatattctcagaagtctctgaaaaaatattgatactggaaacatacttcaagaataatgaagatgatgatactgaactaatgaagaagaaaatataatccctactttgctgtaaagtgattagcattcacattcaacactcataaaattatttatataattatagtaattcaaatagtatttattagttttccgttattgcaaccaaactataaacaaatcaaaaagatttccagaattaatgcaaggtggtaattatcttgtaacagaaaattaaagatataacattgatgttttatatgtgtgtgtgtgattatatacatacacatttacacataaaatattttgagggaaagggcaggtgacagatatagatacaggtattaaattaaatcctcactgtgtgtaacagagtagttggtaatctattaaagtttaaacatagcttggagtaaaagacataaccaccaaaaagaagaacaacaaaaacatacacatacacaaacaatatatatatatttttatattttttttattatactttaagttctgaggtacatgtgcacaacgtgcaggtttgttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgagctcatccttttttatggctgcatagtattccatggtgtatatgtgccacattttctttatccagtctatcattgttgaacatttgggttggttccaagtctttgctacacaaacaatatttttaagaggccatcactaaaaagggactagatggaggacattttcaaaaggaaagtttaatttttttatgatgatgttgtctttgttgttttattatgatttgtataaatatgcacatattatttatgctaaagttaacatacttctgaaagaaaagaaagtatatatactttgtaaactatagacagttttcataggaagcaagaaagaaatgtctcacagcttagggaggtgagagtatgtgctcaagacatattattttaaataaaaatgttgaagcatagtacacaggcaaaaagagcagatattacaaataataggctcatgaaatatcactaagttgatacaccctgcaactaccatccaggtcaagaactaatcaacggtggtacctcagaagcatccccctcattacctggtttctcattctcaaagttaaacattatctcagttagtttggcctacttctgaactgtacatcaatgacaatatataatatgtgtttttatctctttcacctaatactatatttgaatagaccacaattatttatttatgttgtctaatgttgatggacattggtgtgattgccagcttctgggtattacaggcatgcttcaatttacaactttagaagttttctggttaacatatgtatgggttgctactggatagatatacagctggcaaacttgggatagaagcagaataaactctaagtgattttggcaggaaaatgatgagctaagtaagttaggacagacataaatgaacacggctcatgttttgccagagatttaaattttttaaaaagtttcactccagtgttagtgatccaaccactgtgctgcaaatttgtgtagactgtcatttaggagagaagatgatgtctgtgaagattaaatgcagtgaacttcgaagtcctctatagtaaaaaggctttaaagaacatggaataacataagagagggtatttacctatttgaacatgatggtaccctttccaaagatgtagagtaatccgagtatcataaaaatattcctgtggccagatttctggtgtcatttaaagagctccctattgacttggtgatctcaacctggctaagaaaattctaacatctcagaagactttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaa

SEQ ID NO: 198 - DNA, 12521 bp, Homo sapiens
aggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaa

SEQ ID NO: 199 - DNA, 12452 bp, Homo sapiens
aggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataa

SEQ ID NO: 200 - DNA, 26592 bp, Homo sapiens
aggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaactgtcaccactatctaatcttagaacatttttgtcacccccataagctgccctatatcatgagctgtcactctccattcctcttgagcccccaacccctgtcaagtactaatctactttctctatatatgtatttgcgcattctggacatttcacataaatgcaatcatatagtgtgatcttttgtgcctggtgtctttcacgtagcatgttttcaaggttcatcatattatagcccatgtcagtacttcagttctttttagagatgaataatattctattgtctaggtacagacatgccacattttgttaattaccatcagctgatgaatattttgactagaattcaggcattatacttttatttttaacctttcattttgaattaatttcacactgttgaaaaattagtaaaattatttcttatacacccttctcccagatttcccagttattaacagcttatataatcacagtacaatgatcaaacatcgatacaatactattatctcatctaaagaccttattcaaatttctccctctgttgtactaacattctttttctagcacaggatccaacccaggatcacatattgcatttaattatcatgtctccttagtctttttaaatctggaacatttcatcattttttaactttgagactttacatttttaactttaaatatatattatttttatgttatatattttttagaaatagggtctcactctgtaacctagactgagggcactggcatgattgtagcttactacagccccaaactccttggttcaagtgatcctcctgcctcagccttctgagtagctaggactacaggcatgtgatactgtacctggctaatatttaagatttttttgtttagagacaggattttgttttgttgccaaggctgatatcaaactcctggctttaagcaatccttctgtcccagcctcccaaaatgctggaattacaagtatcagccactgggcctggccttagttttatattttaaaagctaagcacgcttactgcagaagaatatataaaacatgtaagacagaatgaatagaaatcacccttatttcattaccattagatggtcactattgacaatttgatctatttctgtccttctattcatattattgaaaatataatttatattctcttttaaaccagcattatatcatgaccattttccatgcattaagaactcttaaaaaacataatagtttcataatggtccatcttgtggttaatacatactgccctccagcatatctgtgatattaaacatttaggttttctctggtgaaacaaaatgaaattagtcaatgtgtatgaactgttttaaggttactaatttgtattgctaaaatgacttccaaaatgatgatatcaatataaattcccttaggactctgtgaaagcctgtttcaccacaccatcctcagcactggggaaattcatctttttccaatgtttgaaaaattaaattccactgtgcctttagtttgcatttccttattagtgatattaacttttaaaaacagttatcaatttgtgtattttctttggtgaattgtctctttgtatgcaaaatataattttttaattataaaagaaatcaaggaaaaggtatgctttacacactatgcttattttctgcctttttttaaaaaaaaaataaaagtaacttcaacatttattttagattcagaggggtacatgtgcaggcttgttacatgggtctattgcgtgatgctgaggtttgggatatggatgatcccatcatgtaggtagtgagcatagtacctaagaggtagtttttcagcccacactccctttctccttctcctctctagtagtctccagtgttgatcgttgtttccatttgtatgtctatgtgtactcagttcttagctcccacttataagtgaaagcatgtggtatttggttttctggtcctgcattattttgtttaggattagcctgccgctgtatccatgttgctgcaaatgacatttcattatttgtatagctgtgcagcattctaaggtgaacatataccacagtttccttattcagtctactactgatgggcacttgggttgattccatgtctttggtattgtgaatggtgcagcaatgaacattcaagtacatgtgtctttttggtagaacaatttattttcttctgggtgtatacccagtaattgggttactggttgaatggtagctccgttttatgttctttgagaaatttacagactgccttccacagtggctggactaattttcattctgacagtgtgtaagcatttgcttttctccatggcctcaccagcatatgtcattttttgactttttaatatagcaattctgactggtgtgagatggttttccattgtggttttcatttgaatttctctaatgattagtgatgatgaggattttttcatgtttgttgtatgttttcttttgagatgtgtctgttcatgtccttttcccatttttgatgggattatttctttattgcttgttgatttttttaagttccctatagattctggatattaggtctttgttggatgcatagtttgtgaatatctgctcccattctttaggtagtttgtttgctctattgatagtttcttttgttgtacagaagttctttcgtttaattagggctcacttgtctatttttgttttagttacaattgcttttggggatttagcccaaaattctttgccaaggcctctgtcatgaagagtatttcctatgttgtcttccaggatttttatagtgtgaggtcttacatttaaatctttaatccattttgagttaattttttacatgtggtgaagggtagtggtccagcttcaatcttctgtatatggctagccagttatcccagcatcatttattgaaaagggagtccttttcccattgcctatttttgtcagccatgtcaaaaatcagatggttgtagttttgccactttatttctgtgttttcttttctcttccatttgtctatgtgtatgttttcataccagtagcaagctgttttgggtactgtggctttacaatatagattaaggtctggtagtgtggtgcctccagttttgttctttttgcttaggattgttttggctatttgagctctttttttgtttcatatgaattttaaaatagtttcttctaattctgtgaagaatgacattggcagtttgatagaagtaaccttgaatctataaatttctttgggcagtatggccatttttatattgcttcttctaatccatgaccatggaatgtttttccatttattcatgttgtctctgatttctttcaacagtgttttggagttctccttgtggagatatttcaccctcttggttagctgtgttcctaagtattttaatttctttgtagtgattgtaagtgggattgttttcttgatttcactctcagcctggacattgttggtttatagaaatgctgctgatttttgtacattgatctttgcatcctgaaactttactacaatttttccttttttttctttcttttttttttgctaaagtggtttatgaattttgggagccttttggcagagtctttagggttttctaggtatagaatcattttgtcagagaagatagtttgatttcttctttgcctatttggatgccttttatttctttctcttgactgattgctctggctagggcttccaatactattttgaataggagtggggagagtggacatatttgtcttgttacagttctcccagggaataatgctttcagcttttgtctcttcagtatgacattggctatgggtttgtcatagatggctcttattattttgaagtatgttcttttaacacatagtctgttgagtgtttttatcatgaagggatgttggattttatctaaagctttttctgcatctattgagatgatcctatggcttttggttttaattctgtttatgtgatggatcacatttattgatttgtatatattgaaccaacctcacatcacaggaataaagcctatttgatcttggcaaattaactttttaatgttgattcaccaagatcaagtagaatttattctggagcctacggactggcgctgacattgtagaatgagtaagggaggagcccctcatccctgattttttagaatagtttcagtaggattggtacccatttttctttgcatgtctggtaaaatttggctgagaatctatctggtctggggctttctttgattggtagtttttttttttcaattgttgattcaattttgaatgtgttattgttccgttcaggttttcactttcttcctggatcaatcttgggagattgtatgtttccacgaatttatccatttcctgtagattttctaatttctgtgcatcaagttgttcataatagtctctgaggatcttttgtatttctgtggtatcaattgtaatgtcatctttgtcacttctgattttgcttatttagatcttctgggtttttttcattattagtctagctagagatctatgaattttgtttattcttttgaagatctaggtcttggtttcattgatcttttgcatggatttttgcatttcaatttcatttagttgttctctaattttaattatttatttctctgttatctttggggttggttcttttttttttttaagttcctctaagtatggtgttggattgttaacttgaggtctttctaacttcttgatgaaggtgtttagcactataaactatctccttttaacactgttttagctgcatcccaaagattttggtaagttgtgtctatattttcattaatttcaaagaattttttttatttctgccttaattattttgttcatgcaagagttactgaggagcaagttgtttaatttctctgtatttgtatagttttgagagatcttcttggtattgatttccatttttattatggtgtggtccaagagtgtgcacagtatgatatcaacttttttgaatttattgagacttccttaatgattgagcatatggttgatattagaatatgttccatgtgcagatgagaagaatatatattctgttgcagttgggtatagtattctttaaatgtctattgggtccaattggctgagtgtcatgtttaaatccataatttttttgttcatttctgcctcaatgatatgtcagtaaagtctgtcagtggagtgttgaagttttccattattattgtgtgggtcttcttgtagttgttttatgaatctggatgctccaatgttgggtacatatatgtttatgatagttaaatcttcttgttaaatcaaaacctttcattatgtaatgtccttctttctgctttttgtttgttgatgttttaaagtttgttttatctgatataagaatagtgagtagtgctcttttttccttcctgtttgcacggtagatcctgctacttttagcctgtggatgtcattacgtatgagatggatctctaaatgatggcagagagtttgatcttgtctttttatccagttggccactctatgccttttaagtggggtgtttagactgtttacattcagggttattattgatatctgagattttgaccctgtcatcatattgttagctggttgttttgtagaattgattgtgtagtttctttatagtgtctgtgggctatgtgcttaagtgtgtttttgtggtagcaggtatcattcttttgtttccatgtatagcactctgttaaggacctcttgtaaggttggtctagtggtaataaattccctcagtatttgcttgtctgagaaggattttatttctcttttgcttttgaagcttagtttggcagaatatgaaactgttggtatgaaatttctttttttttttttaaggatactggaaacaggctccctatgtcttctgccttgtaagaattctgctgagaagtccactgctagcttgatgggattccctttgtaaatgaacggatccttctctctagctacctttatgatgttctcttttgcatttaccttgatgattctggtaactatgttccttggggattgtcatcttgtatagtattttgcaggggttcttggtatttcttgaatttgcatgccagcctgtctagcaagattggagaaatgttcatggattaataataatgtcaatgacttgtaggtttggtctctttatataaccatatatttctcagatgttttgttcattttttaaaaattattttttaaaaaatttttatctgagtttactcaaataactggtcttcaagctctgagattctttctgtggcttggtctattctgctgttaatgcttcttattgtattatgaaattctcatagtgaattttttcaattccagaagttcagtttggttcttttttgaaatggctattttgtcttttagctcttggatcattttactggattccgtgaatttctggattgggtttgaatgttcttcttgatctcaatgagcttccttgccatccacaatgaattctatgtgtgtcattttagtcatttcaaactgattggataccattgcttatgagctagggtgcttatttggagggaaaggaacactctgactttttgaattctcaggtttcttgcatggattctttctcatttgagaggactggtgtttctttagctgtagcataagttgagtataatcaattggctttgtttctgggcgctttcagggtgccaatgctctgtacaggatctgtacttaaagctggatttttgccccttctctaggagctatttggggccaggaactgtccctgacatttgacaaatctatgcagggttcccagcttcctccctcttcagccttggggtctgcctcacctctcttttgactcttggtattttctctttgaaaatctgttcaaaatatgttagcttacccaatttttggtctttcttggtgacagcagtgcttcctgactgtgtccagttggacgtcttgtccagaacccctggtgattatttttaaaatgaagctttgttgtagcactcttggccaatttaatataatgtccttttttccctttataagttagccttcatgtcttcagtctacacttagacattcaggtcctaaatattacctttgcatattcagtatacaccagctccattcatagctgaacacttcaccaggttcctaattcctgaaagaacagaagccatatctgtatcccaggaggctggggcgacaagatggtggatctccccttattttcttttcatacattttttcaccaaaatttgacttgtatttgcagctatctgctatcaaacactagaagttattctttctcactgtatttttgtagctatcaaccaacttttcttcatccctctctcccctctacttttctcaacctctgttaaccactattctactttttagctccatggcataagtattttttagttcccacatatgaattataacatacaatatttttctttttgtgcctggcttatttaacataatatcctccagttccatctatgttgctgcagaatgacaggatttcattctttttatggctgaatattccattgtgcgtatataacacattatccatttatctgttggtggacatttagcttgattccatatcttggctatggtgaatagtgttgcaacaaatataggagtacagatacctctgcaatatatttatttactttcttttggacatatacccagcagtgggatttctggatcatatggtagttctactgtttataaattttttgtactggctgtgctaattctaattcccaccgtaagtatatgaatgttcccctttctctgcatctttaccagcatctgttattttgtgtctttttgataatagccattttaactgaggtgagttaataattcattgtagttttgatttgcagttccttgatgattagcaatgttgaacattttttttttcatatacctattggccatttgtatgtcttcttttgagaaatgtctattcagatcttttgcccattaaaaaaaaatcagattgttattaatattatttttgctattgatttccttatgtattttggttgttaatcccttggcacatgtataatttgcacatattttctcctattttgtaggttatgcattcatttgtttattgtttttgttttttgctatgcaaaactttttagtgtgatgtaatcctatttgtctctgagtcttcttatccttatcttagaaatgaatctaatactatttgtctgtctgtgttgttggctgtgcttttgaggtcttactcaaaaaatatttgctaagattgttatcctaaagtatttcctcattgttttcccctagtagtttcatagttttggttcttatattaagtttttaatccatttttattttatttttgtatgggctaagagataggggtctaattttattgttctgcatatgggtgtccagtttttcccacaccaatcattgaagagactatcctttccccagtgtatgttcttgatgcctctgtcaaaaatgagttggctataaatgcctgggtttatttctgggttctctatttttttccattggtctatgtatctgtttttgtgccagtaccatgtaactctggttactatagctttatagtacattttcaaatcaggcagtgtaatgcctccagctttgttctttttgctcaagactgctttgggtattccaggagaatgacatttttgaagaatactagccaattattttatgcaatatccctcaatttagaatttttagatgcttcttcatgagtaaatttagatgatgcatatttggccagaatagcatactgcatccttctcagtgcattgtatcaggaggtatgtgatatcaatttctcccagttgtggtgataccagctttgatcacttggttaaggggaaatctgtcaggtttctgaaaagagttcctgttttcctttgtatttaataagtatcttgtggggagatattttgagactgtgtaagtatcctgttccacatgataatctccttcactaagtttagcacctgttggtacttacctacaacagttattaccgtggtgtttgccaaatggtgattttctactctcatcacttcttatacatttatttctccaaatactgctgtgagaaagagtttaccatgctctcctatttatatatttacttatttataacattgtggtctcatggattcttactttattctatgggttataatccattactgttgttatttatgttgttgatcaaactgttttaagatttgcccattgggagactgttccatttgactcttgactttttttttttacatgcccttgttatttattgtgctattccttattttcttttataagttgatcttatacttttctttgtctggaattagccatttctccaaggaaatctgatgacttttactggaggaaggtacttagaaatcatgatctggaccgtgttctattttatcttctccctatgagttaggcacaattagcaatcctacatttttaatgaaataactgagaactcaagaagttaaataatacatctgatgccacacaactgaaggtgatagaactactatttgaacccagtctaaagtttggtctccagtgtccatacttaaatttaatttctctctgggattggaaagcttttccagtgtctctgagtcttcttttccttgtcttagcaatgagtctagtactatttgcctctcagtgttgttgtgatggctaaatgaaaggacacatcggaaattgtctatacattatttgttccatagtggatactcaaatatacgttgaatttgagctatattcactcagtattcataaacacccactttgttcgcagcactgaggtagaaaatatgcaggtacatgcatatttcctggtaagagctcatatttcctggcaataatttctaatgtcactccttcctgtgcatccaatataggataccagaatcctttccaagatagaatttaggcagacactactgaacaaatgaaacgtatttgctgccctagacatgagtgatgaagggttgggagaacaggcgtgactctaccaaaaacaggcagataatccaggctcacatttcaaaacaccttgcaacttaagtttctaaccattttctaacagtccttgaaattatgctaatataaggacttccaggcaacatagaagactgggtgtacatgctaatacacaaatgacatagaggatcagcatcccaacttcttggaatatgccagacagtaataaatgtaacagccacaaaattccagccttgcttaatttggggaaatgagaatcagtttgttcttcccctgctggcactgaacagtggtttgcaggatcactgcgtgggaaagatctgacagtagagatctgagaggctgtctgtgtgaaggctgaatttcatgaactatctcattgttgggatggttccctttcagcctcgtggtaagtacaacactcaggtcactgtaagcgcagggcaggcaagcttaagccacaatgagtgaaaatatgtgtgtattgggttgggggaagggattttagtctggattatctgaagctcagactttaagctgagagcctgggctgccaagcaggtatatgtaaaggacagctcaaagctgaggtttaaaactagtatgctccaaccaggctgtgaaagtaactaaagtagctgagtgcctcagatcacctaatgtttatttttgttttgttttattttttgtttttccatttttgttgttgtttgtttgttgttttttctgagacagagtctggctttgttgtctaggctggagtggagtggcacgatctcggctcactgcaacctccgcctcccggattcaagcgattctcctgcctcaacctcctgagtagctgagactacaagcgtgtgccaccacgcttggctaatttttgtatttttagtagaaacggggtttcaccaagttagccaggctgttctcgaactcctgacctcagggaatccacccaccttggcctcccaaagtgctgggattacaggcgtgagccaccacccccagccgccctaatgttttacaagtttgagacataaacctgtggcatgcttttttttgggaacatgattcagaaatcactttttcctatcaaaaagcagaaaaatgagccatgatgattggaatccttcctgatcttataggtagactgggaaagcatagctgggaagagcacagacagggagatcagaagaacctcggactgccacaaaatgtgtaatgccaggtaacctaagccagccagtcaatttatctggggatcacttcttcacttgtacagcgaacaagatgaattagataattgtataattccttggagctctgaaattctactgcacaaatagatgcctcgtgatcgctgttgagatgaggtcttccagagcctgtgatcccagatgtgattgatcatcttgccagagctttagccaccttctcacctgttagacaattcctgcccctgtgtctctactgtatcgcctttcacagctcatatgctgcacctatgcagtcttcttcagggtaagctgtgtgaagtttaagtttcttataactattaaacttcatcttgcaaaggattcttcctttgaagaccaggttgcaaagtaaataaaaatgaaactacacttgataaagcagggatgggaagtctgtaaccttatccttattgtgggatatttgaattgtctctattttttgctatttgtcttcaagttgtcctaagaaggtgggatcaatatcccccatcctattggttcagagtcaagactaatgatgccacacatgcatgaagagtgtatggaaacatttattatttacatcatgaggctttctagggagagcagaggaaacacccaagcttttctattagatttgagtgaggaaggcacaagtggctttggtttctactgtgtgtgggtgtgggctggcattagggctcccgtgtacaggctcaagtttacgtggtttgacttctatgctagtgccaaggaaaggagggcctgggatttttttttaattggcttgctcatgtgtgaggggaaaagagaagtgggagaaaaggggtctgaaagctgtcagcagccagataatggagtcagatgatcttacatattagaaaattccaaggaaaccactaaaaacctattagaactaatacatgagttagcaagattgcaagatacaagatcaatatgtgaaaaatcaattttctttctatacatttacaaagaactatccaaaaatgaaattaagagaataatttcattcacaatagtatataaatatattaaatatataggaataaatttaatataatgtgtaaaacttacatggtgaaaactcaaaacattaaaaaattaaagaagagcaaaataatagaaagtccatattcatgaattaaaagtcttaatattatcaaaatgacaatatttctcaaatttatctagattcagcacaattcctatcaaaatctcagctggcttttttttttttgcagaaattgaccagctaattttaaaattcatattgaaaagcaagggatccagaataacaaaaataatcttgaaaaagaagacaaagtaggatgacttgctggtatggtttggttctgtgtccccacacaggtctcctcttaaattgtaatcttgtaattcccatatgttatgggagggacccagtgggagatgatttgaatcatggggatagtttcgcccatactgttctcgtggtagtgaataagtctcacgagatctgatggttttatcaggggtttctgcttttgcatcttcctcattttctcctgctgccactatgtaagaagtgcctttcatctcctgccatgattctgaggcctccccagccatgtgcaactgtaagtccaattaaacctctttttcttcccagtatcgggtatgtctttatcagcagtgtgaaaacggactaatacactcacacttcccaatttcaaaacttcaaaaacagttatgaagaaagtatagtactagtatgaggataaatgtatagatcaatgtaataaagttaaaaattcagaaataaagccttacatttaaggtcaattaatttttgacagtggtgccaagacatttcaatgggaaaagaacaaccttttcgacaaatgatgatgaggcaacagaatatgcctgtactcataaataaagtttcaccccttccttatacaatatacaaaaattaactcaaaatggatcatagactaaatgtaacagctaaaatgataaaatttttagaagaaaacataggagtaagtcttcatgaccttgggctaaacttcttagcaatgataccaaaagcaaagcaaccaaagaaaaaatagtgacccttagaatcaccattaaataggaagatagtaccccttgtattatgggccttaatttctataggccttgtttttttaatctgtattgggacatattaactattttaaccagagatggattattctattttaggttcgtggtattccatttttttaagctgattttcaatgtcaaagatttaattttatttcaatttattactcattgggttaggtcatatctactacgtgatatatgttaaggcaacaggtgctaaggccatggagaatttagagaaggaaagtgtaccagtagtcaaggtgaggcatacctgtttgccctctactttg

SEQ ID NO: 201 - DNA, 23984 bp, Homo sapiens
aggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaactgtcaccactatctaatcttagaacatttttgtcacccccataagctgccctatatcatgagctgtcactctccattcctcttgagcccccaacccctgtcaagtactaatctactttctctatatatgtatttgcgcattctggacatttcacataaatgcaatcatatagtgtgatcttttgtgcctggtgtctttcacgtagcatgttttcaaggttcatcatattatagcccatgtcagtacttcagttctttttagagatgaataatattctattgtctaggtacagacatgccacattttgttaattaccatcagctgatgaatattttgactagaattcaggcattatacttttatttttaacctttcattttgaattaatttcacactgttgaaaaattagtaaaattatttcttatacacccttctcccagatttcccagttattaacagcttatataatcacagtacaatgatcaaacatcgatacaatactattatctcatctaaagaccttattcaaatttctccctctgttgtactaacattctttttctagcacaggatccaacccaggatcacatattgcatttaattatcatgtctccttagtctttttaaatctggaacatttcatcattttttaactttgagactttacatttttaactttaaatatatattatttttatgttatatattttttagaaatagggtctcactctgtaacctagactgagggcactggcatgattgtagcttactacagccccaaactccttggttcaagtgatcctcctgcctcagccttctgagtagctaggactacaggcatgtgatactgtacctggctaatatttaagatttttttgtttagagacaggattttgttttgttgccaaggctgatatcaaactcctggctttaagcaatccttctgtcccagcctcccaaaatgctggaattacaagtatcagccactgggcctggccttagttttatattttaaaagctaagcacgcttactgcagaagaatatataaaacatgtaagacagaatgaatagaaatcacccttatttcattaccattagatggtcactattgacaatttgatctatttctgtccttctattcatattattgaaaatataatttatattctcttttaaaccagcattatatcatgaccattttccatgcattaagaactcttaaaaaacataatagtttcataatggtccatcttgtggttaatacatactgccctccagcatatctgtgatattaaacatttaggttttctctggtgaaacaaaatgaaattagtcaatgtgtatgaactgttttaaggttactaatttgtattgctaaaatgacttccaaaatgatgatatcaatataaattcccttaggactctgtgaaagcctgtttcaccacaccatcctcagcactggggaaattcatctttttccaatgtttgaaaaattaaattccactgtgcctttagtttgcatttccttattagtgatattaacttttaaaaacagttatcaatttgtgtattttctttggtgaattgtctctttgtatgcaaaatataattttttaattataaaagaaatcaaggaaaaggtatgctttacacactatgcttattttctgcctttttttaaaaaaaaaataaaagtaacttcaacatttattttagattcagaggggtacatgtgcaggcttgttacatgggtctattgcgtgatgctgaggtttgggatatggatgatcccatcatgtaggtagtgagcatagtacctaagaggtagtttttcagcccacactccctttctccttctcctctctagtagtctccagtgttgatcgttgtttccatttgtatgtctatgtgtactcagttcttagctcccacttataagtgaaagcatgtggtatttggttttctggtcctgcattattttgtttaggattagcctgccgctgtatccatgttgctgcaaatgacatttcattatttgtatagctgtgcagcattctaaggtgaacatataccacagtttccttattcagtctactactgatgggcacttgggttgattccatgtctttggtattgtgaatggtgcagcaatgaacattcaagtacatgtgtctttttggtagaacaatttattttcttctgggtgtatacccagtaattgggttactggttgaatggtagctccgttttatgttctttgagaaatttacagactgccttccacagtggctggactaattttcattctgacagtgtgtaagcatttgcttttctccatggcctcaccagcatatgtcattttttgactttttaatatagcaattctgactggtgtgagatggttttccattgtggttttcatttgaatttctctaatgattagtgatgatgaggattttttcatgtttgttgtatgttttcttttgagatgtgtctgttcatgtccttttcccatttttgatgggattatttctttattgcttgttgatttttttaagttccctatagattctggatattaggtctttgttggatgcatagtttgtgaatatctgctcccattctttaggtagtttgtttgctctattgatagtttcttttgttgtacagaagttctttcgtttaattagggctcacttgtctatttttgttttagttacaattgcttttggggatttagcccaaaattctttgccaaggcctctgtcatgaagagtatttcctatgttgtcttccaggatttttatagtgtgaggtcttacatttaaatctttaatccattttgagttaattttttacatgtggtgaagggtagtggtccagcttcaatcttctgtatatggctagccagttatcccagcatcatttattgaaaagggagtccttttcccattgcctatttttgtcagccatgtcaaaaatcagatggttgtagttttgccactttatttctgtgttttcttttctcttccatttgtctatgtgtatgttttcataccagtagcaagctgttttgggtactgtggctttacaatatagattaaggtctggtagtgtggtgcctccagttttgttctttttgcttaggattgttttggctatttgagctctttttttgtttcatatgaattttaaaatagtttcttctaattctgtgaagaatgacattggcagtttgatagaagtaaccttgaatctataaatttctttgggcagtatggccatttttatattgcttcttctaatccatgaccatggaatgtttttccatttattcatgttgtctctgatttctttcaacagtgttttggagttctccttgtggagatatttcaccctcttggttagctgtgttcctaagtattttaatttctttgtagtgattgtaagtgggattgttttcttgatttcactctcagcctggacattgttggtttatagaaatgctgctgatttttgtacattgatctttgcatcctgaaactttactacaatttttccttttttttctttcttttttttttgctaaagtggtttatgaattttgggagccttttggcagagtctttagggttttctaggtatagaatcattttgtcagagaagatagtttgatttcttctttgcctatttggatgccttttatttctttctcttgactgattgctctggctagggcttccaatactattttgaataggagtggggagagtggacatatttgtcttgttacagttctcccagggaataatgctttcagcttttgtctcttcagtatgacattggctatgggtttgtcatagatggctcttattattttgaagtatgttcttttaacacatagtctgttgagtgtttttatcatgaagggatgttggattttatctaaagctttttctgcatctattgagatgatcctatggcttttggttttaattctgtttatgtgatggatcacatttattgatttgtatatattgaaccaacctcacatcacaggaataaagcctatttgatcttggcaaattaactttttaatgttgattcaccaagatcaagtagaatttattctggagcctacggactggcgctgacattgtagaatgagtaagggaggagcccctcatccctgattttttagaatagtttcagtaggattggtacccatttttctttgcatgtctggtaaaatttggctgagaatctatctggtctggggctttctttgattggtagtttttttttttcaattgttgattcaattttgaatgtgttattgttccgttcaggttttcactttcttcctggatcaatcttgggagattgtatgtttccacgaatttatccatttcctgtagattttctaatttctgtgcatcaagttgttcataatagtctctgaggatcttttgtatttctgtggtatcaattgtaatgtcatctttgtcacttctgattttgcttatttagatcttctgggtttttttcattattagtctagctagagatctatgaattttgtttattcttttgaagatctaggtcttggtttcattgatcttttgcatggatttttgcatttcaatttcatttagttgttctctaattttaattatttatttctctgttatctttggggttggttcttttttttttttaagttcctctaagtatggtgttggattgttaacttgaggtctttctaacttcttgatgaaggtgtttagcactataaactatctccttttaacactgttttagctgcatcccaaagattttggtaagttgtgtctatattttcattaatttcaaagaattttttttatttctgccttaattattttgttcatgcaagagttactgaggagcaagttgtttaatttctctgtatttgtatagttttgagagatcttcttggtattgatttccatttttattatggtgtggtccaagagtgtgcacagtatgatatcaacttttttgaatttattgagacttccttaatgattgagcatatggttgatattagaatatgttccatgtgcagatgagaagaatatatattctgttgcagttgggtatagtattctttaaatgtctattgggtccaattggctgagtgtcatgtttaaatccataatttttttgttcatttctgcctcaatgatatgtcagtaaagtctgtcagtggagtgttgaagttttccattattattgtgtgggtcttcttgtagttgttttatgaatctggatgctccaatgttgggtacatatatgtttatgatagttaaatcttcttgttaaatcaaaacctttcattatgtaatgtccttctttctgctttttgtttgttgatgttttaaagtttgttttatctgatataagaatagtgagtagtgctcttttttccttcctgtttgcacggtagatcctgctacttttagcctgtggatgtcattacgtatgagatggatctctaaatgatggcagagagtttgatcttgtctttttatccagttggccactctatgccttttaagtggggtgtttagactgtttacattcagggttattattgatatctgagattttgaccctgtcatcatattgttagctggttgttttgtagaattgattgtgtagtttctttatagtgtctgtgggctatgtgcttaagtgtgtttttgtggtagcaggtatcattcttttgtttccatgtatagcactctgttaaggacctcttgtaaggttggtctagtggtaataaattccctcagtatttgcttgtctgagaaggattttatttctcttttgcttttgaagcttagtttggcagaatatgaaactgttggtatgaaatttctttttttttttttaaggatactggaaacaggctccctatgtcttctgccttgtaagaattctgctgagaagtccactgctagcttgatgggattccctttgtaaatgaacggatccttctctctagctacctttatgatgttctcttttgcatttaccttgatgattctggtaactatgttccttggggattgtcatcttgtatagtattttgcaggggttcttggtatttcttgaatttgcatgccagcctgtctagcaagattggagaaatgttcatggattaataataatgtcaatgacttgtaggtttggtctctttatataaccatatatttctcagatgttttgttcattttttaaaaattattttttaaaaaatttttatctgagtttactcaaataactggtcttcaagctctgagattctttctgtggcttggtctattctgctgttaatgcttcttattgtattatgaaattctcatagtgaattttttcaattccagaagttcagtttggttcttttttgaaatggctattttgtcttttagctcttggatcattttactggattccgtgaatttctggattgggtttgaatgttcttcttgatctcaatgagcttccttgccatccacaatgaattctatgtgtgtcattttagtcatttcaaactgattggataccattgcttatgagctagggtgcttatttggagggaaaggaacactctgactttttgaattctcaggtttcttgcatggattctttctcatttgagaggactggtgtttctttagctgtagcataagttgagtataatcaattggctttgtttctgggcgctttcagggtgccaatgctctgtacaggatctgtacttaaagctggatttttgccccttctctaggagctatttggggccaggaactgtccctgacatttgacaaatctatgcagggttcccagcttcctccctcttcagccttggggtctgcctcacctctcttttgactcttggtattttctctttgaaaatctgttcaaaatatgttagcttacccaatttttggtctttcttggtgacagcagtgcttcctgactgtgtccagttggacgtcttgtccagaacccctggtgattatttttaaaatgaagctttgttgtagcactcttggccaatttaatataatgtccttttttccctttataagttagccttcatgtcttcagtctacacttagacattcaggtcctaaatattacctttgcatattcagtatacaccagctccattcatagctgaacacttcaccaggttcctaattcctgaaagaacagaagccatatctgtatcccaggaggctggggcgacaagatggtggatctccccttattttcttttcatacattttttcaccaaaatttgacttgtatttgcagctatctgctatcaaacactagaagttattctttctcactgtatttttgtagctatcaaccaacttttcttcatccctctctcccctctacttttctcaacctctgttaaccactattctactttttagctccatggcataagtattttttagttcccacatatgaattataacatacaatatttttctttttgtgcctggcttatttaacataatatcctccagttccatctatgttgctgcagaatgacaggatttcattctttttatggctgaatattccattgtgcgtatataacacattatccatttatctgttggtggacatttagcttgattccatatcttggctatggtgaatagtgttgcaacaaatataggagtacagatacctctgcaatatatttatttactttcttttggacatatacccagcagtgggatttctggatcatatggtagttctactgtttataaattttttgtactggctgtgctaattctaattcccaccgtaagtatatgaatgttcccctttctctgcatctttaccagcatctgttattttgtgtctttttgataatagccattttaactgaggtgagttaataattcattgtagttttgatttgcagttccttgatgattagcaatgttgaacattttttttttcatatacctattggccatttgtatgtcttcttttgagaaatgtctattcagatcttttgcccattaaaaaaaaatcagattgttattaatattatttttgctattgatttccttatgtattttggttgttaatcccttggcacatgtataatttgcacatattttctcctattttgtaggttatgcattcatttgtttattgtttttgttttttgctatgcaaaactttttagtgtgatgtaatcctatttgtctctgagtcttcttatccttatcttagaaatgaatctaatactatttgtctgtctgtgttgttggctgtgcttttgaggtcttactcaaaaaatatttgctaagattgttatcctaaagtatttcctcattgttttcccctagtagtttcatagttttggttcttatattaagtttttaatccatttttattttatttttgtatgggctaagagataggggtctaattttattgttctgcatatgggtgtccagtttttcccacaccaatcattgaagagactatcctttccccagtgtatgttcttgatgcctctgtcaaaaatgagttggctataaatgcctgggtttatttctgggttctctatttttttccattggtctatgtatctgtttttgtgccagtaccatgtaactctggttactatagctttatagtacattttcaaatcaggcagtgtaatgcctccagctttgttctttttgctcaagactgctttgggtattccaggagaatgacatttttgaagaatactagccaattattttatgcaatatccctcaatttagaatttttagatgcttcttcatgagtaaatttagatgatgcatatttggccagaatagcatactgcatccttctcagtgcattgtatcaggaggtatgtgatatcaatttctcccagttgtggtgataccagctttgatcacttggttaaggggaaatctgtcaggtttctgaaaagagttcctgttttcctttgtatttaataagtatcttgtggggagatattttgagactgtgtaagtatcctgttccacatgataatctccttcactaagtttagcacctgttggtacttacctacaacagttattaccgtggtgtttgccaaatggtgattttctactctcatcacttcttatacatttatttctccaaatactgctgtgagaaagagtttaccatgctctcctatttatatatttacttatttataacattgtggtctcatggattcttactttattctatgggttataatccattactgttgttatttatgttgttgatcaaactgttttaagatttgcccattgggagactgttccatttgactcttgactttttttttttacatgcccttgttatttattgtgctattccttattttcttttataagttgatcttatacttttctttgtctggaattagccatttctccaaggaaatctgatgacttttactggaggaaggtacttagaaatcatgatctggaccgtgttctattttatcttctccctatgagttaggcacaattagcaatcctacatttttaatgaaataactgagaactcaagaagttaaataatacatctgatgccacacaactgaaggtgatagaactactatttgaacccagtctaaagtttggtctccagtgtccatacttaaatttaatttctctctgggattggaaagcttttccagtgtctctgagtcttcttttccttgtcttagcaatgagtctagtactatttgcctctcagtgttgttgtgatggctaaatgaaaggacacatcggaaattgtctatacattatttgttccatagtggatactcaaatatacgttgaatttgagctatattcactcagtattcataaacacccactttgttcgcagcactgaggtagaaaatatgcaggtacatgcatatttcctggtaagagctcatatttcctggcaataatttctaatgtcactccttcctgtgcatccaatataggataccagaatcctttccaagatagaatttaggcagacactactgaacaaatgaaacgtatttgctgccctagacatgagtgatgaagggttgggagaacaggcgtgactctaccaaaaacaggcagataatccaggctcacatttcaaaacaccttgcaacttaagtttctaaccattttctaacagtccttgaaattatgctaatataaggacttccaggcaacatagaagactgggtgtacatgctaatacacaaatgacatagaggatcagcatcccaacttcttggaatatgccagacagtaataaatgtaacagccacaaaattccagccttgcttaatttggggaaatgagaatcagtttgttcttcccctgctggcactgaacagtggtttgcaggatcactgcgtgggaaagatctgacagtagagatctgagaggctgtctgtgtgaaggctgaatttcatgaactatctcattgttgggatggttccctttcagcctcgtggtaagtacaacactcaggtcactgtaagcgcagggcaggcaagcttaagccacaatgagtgaaaatatgtgtgtattgggttgggggaagggattttagtctggattatctgaagctcagactttaagctgagagcctgggctgccaagcaggtatatgtaaaggacagctcaaagctgaggtttaaaactagtatgctccaaccaggctgtgaaagtaactaaagtagctgagtgcctcagatcacctaatgtttatttttgttttgttttattttttgtttttccatttttgttgttgtttgtttgttgttttttctgagacagagtctggctttgttgtctaggctggagtggagtggcacgatctcggctcactgcaacctccgcctcccggattcaagcgattctcctgcctcaacctcctgagtagctgagactacaagcgtgtgccaccacgcttggctaatttttgtatttttagtagaaacggggtttcaccaagttagccaggctgttctcgaactcctgacctcagggaatccacccaccttggcctcccaaagtgctgggattacaggcgtgagccaccacccccagccgccctaatgttttacaagtttgagacataaacctgtggcatgcttttttttgggaacatgattcaga

SEQ ID NO: 202 - DNA, 10869 bp, Homo sapiens
tcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaa

SEQ ID NO: 203 - DNA, 10173 bp, Homo sapiens
aggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagc

SEQ ID NO: 204 - DNA, 1676 bp, Homo sapiens
aggtcaagtttgattctgcatcttatgccatatcatacacaaaattagaggactctgttatctagctgtctcttaggtttttcctacaatttaggactctgaagagtcccttttcctgattattttggctaaaaatttgggtttctttcagggttttattactctacactgtcacacagtggggaccttctttaggttcttactgggactttgtttggagagatgtagtgggaattttaaaaaagagaaaactgatggataccacctccccactctttggacaacagaggctactttcctagtaactgtctcaggaaacaagtcctctttctgggttttatgccattatgctgctgccactgccacagctgccatggaagctcaggtctctggatgacactggccttgggagaggtctagaagggaaaagaagagaagggaaaagtgaatattctttggtcttggggggctcccagatacagttttaactacttctacttggacaactaataaagatgctaaagatgaacaggttattattgtgttgctagatatgtagattaagggcaatctactcttacttaaactttagataagatggaaattttttttcttgggcagtaacaacattaagaacggtgatgatgaaagtgtggttcatgatccagctgcatgaagtccctctatgaaggatgttgaatgtgcatatttctaggccttaactttggctcttgaatcttgattcctagatttgcattctgtattcctgtacacactaaagatttaagacattacttttagatggtgatgaacccctaagtcattgaagtttaagagaccagtagatgattatattattgtatgcggaagatatcaggggcttgaagttgggcctaggcaacagaaatgaaaaatacagggaaaatagaagagatattattgaggtaaggaggacacctgggaactgattaacccttgaaggtaaagaaggggtatgttaaaagatgactcagaggaagtattttggatgcatgtgagaatgatgataccataataagataagggaatgtcaaagtaaactctagatgatttaattagactggatttgagtatggggatttgagtaattctggcatgtctgtatggggtttttgagactctgtttaaggtagggttagtataagacacaccttccaagaatttacaatctgttagtgggattgagaaataaggaaaaaaacaactaaagctaacttggattgagctctttctatatgccaaacacaaatgatgttctaaacattttacatagataggttacgcaacttgcccaagatcacacagctactaagtgaaagagctgagatttaaaaccctgtgttctagactctatgcttttaatgtctatacaattaatattaccaaatttatggcaatttgacctctctagccatcagtttccttatttctaaattaaggataataatctggtagaatgtgtgtgataacaaaatgacaccatatacagaacctagaaatagtaggtgttcaaattgcatgatttagttctcatttttttaagtggttcagattttttaaaatgctgtttgaaaatactgtatctgtaactacaagaccagttttctaaactttcacttatttttggagatcttcat

SEQ ID NO: 205 - DNA, 24940 bp, Homo sapiens
tcacttatttttggagatcttcatggtgcttcaataaaaattttataacactagaagaaaaaaattatctgtttttcttttccttttctatagctttgtagaactattattgaaagacaataaactacacatatttacagcatacaattgaataaatttggacttatatatatgagaaattatcatccctaaatttccctaatgacctttgaaattccttactccttccctgtctgcctctgcctctgagaaatcactaaatgacttatcttgttatagattatttcacattttctagactattatataaaaaatacaatatgtactgttttttctggcttctttcagtataattattttgagattcaaccatgtgtgtatcaatagttcatttaaaaatattattgctgacaaatatttcattgtgtagatatacaatagtttgtttcttcacattttgatgggcatttatgtcagtccaatttttaactttattaaaaataaagcagccatgaatattagtgtatgcatgctttcacatggtacatttacatttaactttttaagaaactgctaaactattttctaaaggaactgtaccattttacatttctaccagcagtgtctaagagttgcagttgctccaaatcctcaccaacacttggtatggtgagtctttttaattatcatattggtttgtgtatgttgaaccatccttgaatttgcgagatagatcctatttgatcatgatgaatgaagttttccatatgtggttgagtttggtttactagtattttcttggggatttttgcatcaatattcatcagggatattggcctatagttttctgtttttgatgtgtcttcatctggttttgatgtgtcttcatctggttttggtatcagaattgataccagaattagcatagcacgagtttagaagtattccctcttcctctattttttgtaatagtttgaataggattggtatttcttctttaaatatttgatagaattcagcagtgaatccatcaggtcccaggcttttctttgctgggagactttttattacagcttcgattttgttacttgttattggtcttttcagattttttatttcttcatggttcaattttggtaggtggtatatgtctagaaatttgtccattacttttagattttccaatttattggcatataattgctcatagtagccactaattatcctttacgttactgcaatatcaatagtaatgtctcatttttcatctctgatttttatttattttggtcatcgctctttttttcttaatctagctaaaggtttgtcaattttgtttaccttttcaaaaaaacaagctttaatttcattgatcttttgtattgtttttgcatttcaattttatttatttctgctctgatctttattatttattttcttctcctaattttgagttttgttgctcttgctcttctagcttctttaagacgcatccttaggttattcatttgaagtttttcttcttttctgatataggagcttatacactcccttgttagtactgctgtcatggtatctcctaggttttggtatgttgtgcttacattatcagtcatttcaaaaaatatttagattatactgcttgggtgataggtacaccaaaatctcacaaatcatcactaaagaatgtactcatgtaaacaaacactatctgttccccaattatatgtatatatatagcttccctcttcacttgacactcattctctctcctgctgccctgtgaagaggtgccttctgccatgattgtaagtttcctgaggcctcctcagccatgcagatctgtgagtcagttaaacctctttcctttataaattacccagtctcaggtattcataataaaatgaaaataaaaataaatttattcattaatttattcattgacccactggtcattcaggagcatattgtttaatttccagtgtttatatagtttctataattcttcttgttattgatttctagttttattccattgtgtcagagaagatgcttgatattagttcaatattttgagtgttttaagacttgttttgtcacctaacataagatttgtccttgagaatatgtgttctgagaagaatgtgtgttctgcagccgttagatgaaatattctgtaaatatctgttagatccatttggtctatagtccagtgtttctttgttatttttttggctggaagatctgtccaatgatgaaagtgaggtgctaaagtctccagctattattgtattagggtctctctctctctctctctctttagctctaatatttgcttcatatatctgggtactccagtgttcagtgcatatgtatttaaaattgttatattctcttgctgaattgaccctttttcattatacagtgatcttctttgtctcttcctatagtctttgtcttgaaatctattttgtctaatataagcatagctactcctgctcatttttggtttccattgacataggatatctttttccatcccttaattttcagtctatgtatgtctttataggtgaagtgtatttcctatagacaacagattattattattttttaatccattcagccactctgtgtcctttgattggagaattcagtccatttacatgtattattattgataaatagggacttgtttctggcattttgtgatttgttttctagttgttttgcggtcatctcttccttctttccttccttgctgtcttttagtgaaggtgattttctcttgtggtatgatttaacgtcttgctttgttttttgtttctattgtatatttttttatttgaggttacaaataatatgaggcttgcaaataatatcttataactcatcatttgaaactgatgacaacactaattgcatcaacaaacaaaaggaaaactaataaaaaatcagcacattaactttttcctcctgctttttaatttttttttgtttctatgtatattgtattataatctctatgtcttgaaaagttgttgtagttattatttttggttcattcatctttcgtcttcctacttagaataagaatagtttacataccacaattgcagtgttataatattctgtgtttttctgtgtacttagtaagaccagtgagttttataccttaagatgatatcttactgttctttaacagccttttcttcctgattaaagaactgcttttagcatttcttgtagggcagtctggtgttgatgaaatccctcagcttttgtttgttttggaaagtcttcaattctccttcatgtgaaggacattttcaccagataagctattctagcataaaagttttttttcctttggcactttaaattaatgttatgccactctttcctgacctgtaaaggtttcctctgaaaagtctcctgccagatgtgttgcagatccatggtgtgttatttttttctcttgctacttttaggatcctttctttatccttggcctttgggggtttgattattaaatgtcttgaggtagtcttctttgggttaaaccttcttagtgttctataaccttcttatacttgaatattgatagctttctctagtttaggaaagtcctctgttattatccctttgaataaactttctactcttgtctctttctctacctcctctttaaggccaattactcttagatttgctcttttgaggctattttctagattttataggtgtgcttcattattttttattctttgttaatcttttttcttttatattctctgactgtatatttctaaatggcctgtcttcaatctcactgattctttcttctgcttatcagctctgctgataggagactctgatgcattcttccttatgtcaattgcatttttcaactccagaatttctgcttgtttcttttaaagtacttgaatctctttgttaaatttatctgataaaattctgaattccttctcttcgttatcttgaatttctttgagcttcctcgaaacagctattttgaattctctgtctgaaaggtcacatagctctgtttctccagaattggtccctggtggttttttaagttcactttgtgaggtcatgttttcctggattgtctcaatgcttgtgggtgttagtcactgtctgggcattcaagtagtagatatttattatagtcttcatagtctgggcttgttggtacccatccttcttggatagtctttccaagtgtttgatgagatttgagtgttgtaatctaagccatatctacattaaggaacacgccaaacccataacactatgcttcttgcagactcatagagataccaccttggtggtcttcagtaagagctggaagaattttctggtttactaggcaaagactcttgttctcttcccttactttctcccaaacaaatggagtttccctctgtgtgctgagctgccatcaaaactgggactctgttgggttagaccttgtattaattcgttttcatactgctatgaagaaatacctgagactgggtaatttacaaaggaaagaggtttaattgactcacagttctgcatggctggggaggcctcaggaaacttacaatcatggcagaaggtgcctcttcacagggcagaaggagagagaatgagtgctgacgaagaaggaagccctttataaaaccatcagatctcctgagaactaattcactatcatgagacacagcatgggggaaaccacctccatgattcaattcttcaatcatgattcaagggtcctgccttgacatgtgggaattattacaattcaaggtgagatttggatggggacacagagccaaaccatatcagacctgaagccagcacagcactgagtctcacccaaggtccactgtaaccactacctggttaccacatgtgattgttcaaggccccagggctctacaatcagcaggtataaatccagccagactcgtgttcctctaggacacagatgggtccagagatgccatctgggagtcagagattggagtgaaaaaccttagaaatctacctgatgctttatttattgcacctaagctggcactcaaaccatgaaacaaagttgtttccactcttcccttccctttccacgggtagatgagccgctccctattgtcaccattaccacaggcccatgaggagtactgccagtttaccaccaatgttcgcttaagactcaagggctcttgggtcagcttgtggtgaatgctgccaggcctgggacccattcttcagggcaatgggttcccactctggctcagggtaggtccagaaatgccatcaaagagccaaggcctggaatcagggatgatcccatttttaagaagattatcctttgcttattgaattgccttggcatctttgtaaaacggtattcaattatgtacgtatacatgtgagtatatttctagacgttctgttttctttcattaacctatatttctatcttaatgccaatatcacatagtcttcatttatatagctttatatttagtcttaaataaatcagggtaagttctccaagttgttcaccgtttttgaagttgttttagctattttaggtcccttgcatttctatggcaattttagaatcagtttgccaatgtctaaaaaaaatcctgctagaattttgattgggattgtcttaaatctatagaaaaatttgagtaatattaaaatattgtttcaatccatgcacatattatatttctcttgtttttagatttatttctctcagcaacatcttatagctttgtttataaattgatcccttaatttcatatttctgtgctattctttgatttctgacagtttattgcttttatatgtacctttaattgatttttatgtgttgatcttgtattatgttacttacataaactcattttatagtcccagaagattcttttgtacatttggtgtgattttctgtatagctgatcatgtcttttgcaaataataacagttttctttctttctttccaatgtagttggactgttattgcacttgtttctgtttctttccttattgcactggtttaaacctccagtcatatgtctaacagaagtggggaagtggccatccttgtcaactttctgatcgtaggtagagtttttaactaaaaatttagtttttaaaatacacgatactactcaggctacatagctttttttttttttttaaatgactgttaatgttttgtaatttaaaaaaattttcaattttttcttagttgttaaaattattgacatgaaattgtttacaatgtccccttattatcccttaaatttccatagcatgatgtcacctcattcattcctgatattgataatttatctattttcttatttttcctgactgagtctggctaaagttacatggtgtttgtagtctttctcaaggccaactttggtttcatagatctttcttttttgttgttctcactattatggatctttgttctttattattatttctctactgcttacttagtgtttaatttcttcttttacaagtttataaatgtggaaatggaagtcattgatttgagatctttctttttttctaatatgacctctaatggtaaaaattttgctctgagtaatttttgttgcatcccacaattttggtatgttgtattttaatttgcaatttgtttaaaatattctctaagtattttggactcatatctctatttaatattttgtttctaaatattttggggttttacagttacttttctgtcactgacttctaacattattttggccagaaaatattctttgtctttgtatctttcttaacaatgtcacaatgtctttcatatagcaaatttttaaaaaaattttcctgagctctagtatgtcacattttcctctgatgaattgtattttttgctatcaactctaagaactcttttcctagtcctggatcatggggattttatattctggaagttttagtgttttatactttacatttaagtgcataatctattgtgctaaaattgtataaattgtgaggtttcgatggaggttcttttcatttcttatattttgttttgttttgctgatgaatgtccagctgcccatcataatttattgtaaactatctttctcttccattgaattgtttgttcctttattaaaaaataattgatcatatttgtgtagaacttttttgggttctgtatactgtttcattgattaatgtatctatcttgccaccaatactatactatcttgattattagacatatataataaaccatgacattgaggagagagatttctcccactttattcttccttttctttcccatataaattcaagaatatgtttctttatgtctataaagaatcttattgacaatttgataggcattgcattaaacctatagatcttataggaaaaaatatttttattcaacaattccacagtatattgagtcttccaattcatgaacatggtatacctcttcttgtatttaggtcttttaaaattactttcacctgaaattataaaatttcagaattttgtaatttttttatacaaattgtatatatactttattagatttatacctaagtatttcatgtatttgggtaattgtaaatggtattacattagttatttcagattccacctgtccattttcagtatatagaaaatgcaattgatttgtttgtattaatcttgtgtcctgacaccttattgaacttgcttattaatttcaggagttcttttatagactccttgaagtgttttatatagacaattatgctgtcttgtaacagagactttttttttcttttccagtttacctgccttttattttacttatttactttttaacatattgcctttcaagacttgttagttgggataaaaacagccttaatctacagctaattttgcccccactatatagagccaatgcctttctgggtcttgtacccagtgcaccatggtttactagattttccactctagttggtgggaacatgaactatcccagctctgtgtaatgtctgaagattgtttcctctggtcctttcaggtagttttcttctagctcttttctaaaaactcatgtagttgcctcccacatatcccctgactagtattcagctgaagacttgcaggtaactctctgcaactttccagagcttttttgatacagctctatctgctgcagtaatctgcctattgagatctagtcatcttaccctcccagctccatctcagcaaactgaagcaatgcttgaaaatacctcatttgttttccctctattaggacacactgtcctacgttgctctatatccaatgtctttcgtatattttgttcagtattttagttgcttcaggtgggtggagggtgggtatgaaagtgattcctgttagtttatctggttggaattgaaagtatcataaaactctatgttgactcagtgtgtttttgaagcttattgggtcttgattattacatttcaaactctactatctgtaagcaaaagagacataggccaagttatccttgtaaagaactcataagaatttcctgacttacctggctgatgcttcctttggggacattgccttcatgatcatatgggtgttggagtgtttgtcatgccaaagagaatctgcatgtgtgactaataagtcagcatttcaagaggcctggctatactctgcttaaaagtgaaaaagcactggattggcaggcataacaaggagaaagtggcattgatatggtaatagtgactttttaatggtctaaggaaagattccctctattctttaactgtgcattggtggtagggtgttgtgtaggtttcttgtctgccaaggcaatgaacagatacattatggtcacttttgtggattataatagggaaaatgatgattcgaaggaaagttaaaaggtatttaataatgagaattgtattagctttcaaatatctgttttcccttcacttacttccttgttatctcttcactgggagatgtgcttccatggctttcatcttttttttcccctcttttaaaagatatttcaaactttcttttcatacatttctcttatatattttaggcaagtagaagaaacccaatgttgtctgcatttgtgtagtttatgtgtgcccaggcctatatgactagtgttttgataacacagaatcatgatctgctttgacattccaaaattatggaggagagaaagtaccactctttgcacccttgttttcttgtaggacccttaaagactaatattaaaacatttgcccttctcaagacaattcaacaccccctcttcttcaggtaatgtctgccaccatgcccaccacttcaactcaagtataccccactgactctattcagtagagagatggcaaaagtgtgaaattgtattctcttccccctatttcagttctctttttgaagaggaaaccaaccaaccaagtttatatcttgaaattactatctgtgggatatttgcagctgagactaagtcctagtgctttcttaataaaagctatgcatgtaaatagggtcagcttttgggctgacattgcatttgaattaaaatctggcatctccacaccattgacaaatctgacagctggagcagcagtcacctcatcatatctctcagttgtgtctttcctggtttttggcatccttcctgtctaaatttttatcagatgagcacttttccttggcaagtactttaaataccttcaacttgttttatctctgaactgtaaccctttgccctcagatgtcatatctcacatgtatgactggaggatattcagaacaaattagttaagaatgcaacaccagagtgcaatttcatttggtcttctccctgccccatcctcttcccaaatattggagcttcctgttgaagagacctttatggacattgattaatttcatggaagctacttaatggtcttgcaaattggaacagttgtaagttttgattgtgacactgcagggctaactccacctgtgctaagcattcagcattgttttctttggctttgcttcattcacgataatcaaggacttgggttcattaccagcattagcaagcctcaaaggcctctcataaatccaagccaaacactgtgttaggaggttccttagattaatggcagccctggttctctgaggctgtgttgagatctgagagaaggtaatgttcactcggcttcagcatttctacttgtagttcaaagccaaacctggaggtacaggatgatctgcaggcaacaagagatagaatgtgggcctgcaaaaggtaccacctgtatacatgatgagctcttcctgcctggcacgcaaagaactttagagttttcctcaagccttttcctatgaaaactctcaggttttgtcagctgggtcaatccattgcctttccaatacacctggagcatttcttccttgatgaattaagggctgaacaaggatgcatgtcaggggtgaaaccctttgaagagtgcaaaaataaaaattggttgtttagtaagtagaaagataaatcaaaaccaatctataaaagttagattcatatctcttttcagggtcacaatttgcctttgttttctagcatcttcatcggtgcttgcaactgaaatgggtcttcttttgactcttggtctttccttagttaagggtgagggagactctttggttctccagcggacaaaagaagacagctaacaaataagtcactctttcttccatagtctatttataagccttacaagttaatgctggaaaggccaatgagaagaaaaataaaacaacagtagtagtagtagtaataagcatgatcatcatcatcatcattggccgcatttttagagaatttgctatgtaccaggcactgttgaaaagaaaaataactttactgagatataatacacattcaataaaattcattcacttgaagtataacagttcagaagtttttaatatatttacagagttgtgcaactgtcaccactatctaatcttagaacatttttgtcacccccataagctgccctatatcatgagctgtcactctccattcctcttgagcccccaacccctgtcaagtactaatctactttctctatatatgtatttgcgcattctggacatttcacataaatgcaatcatatagtgtgatcttttgtgcctggtgtctttcacgtagcatgttttcaaggttcatcatattatagcccatgtcagtacttcagttctttttagagatgaataatattctattgtctaggtacagacatgccacattttgttaattaccatcagctgatgaatattttgactagaattcaggcattatacttttatttttaacctttcattttgaattaatttcacactgttgaaaaattagtaaaattatttcttatacacccttctcccagatttcccagttattaacagcttatataatcacagtacaatgatcaaacatcgatacaatactattatctcatctaaagaccttattcaaatttctccctctgttgtactaacattctttttctagcacaggatccaacccaggatcacatattgcatttaattatcatgtctccttagtctttttaaatctggaacatttcatcattttttaactttgagactttacatttttaactttaaatatatattatttttatgttatatattttttagaaatagggtctcactctgtaacctagactgagggcactggcatgattgtagcttactacagccccaaactccttggttcaagtgatcctcctgcctcagccttctgagtagctaggactacaggcatgtgatactgtacctggctaatatttaagatttttttgtttagagacaggattttgttttgttgccaaggctgatatcaaactcctggctttaagcaatccttctgtcccagcctcccaaaatgctggaattacaagtatcagccactgggcctggccttagttttatattttaaaagctaagcacgcttactgcagaagaatatataaaacatgtaagacagaatgaatagaaatcacccttatttcattaccattagatggtcactattgacaatttgatctatttctgtccttctattcatattattgaaaatataatttatattctcttttaaaccagcattatatcatgaccattttccatgcattaagaactcttaaaaaacataatagtttcataatggtccatcttgtggttaatacatactgccctccagcatatctgtgatattaaacatttaggttttctctggtgaaacaaaatgaaattagtcaatgtgtatgaactgttttaaggttactaatttgtattgctaaaatgacttccaaaatgatgatatcaatataaattcccttaggactctgtgaaagcctgtttcaccacaccatcctcagcactggggaaattcatctttttccaatgtttgaaaaattaaattccactgtgcctttagtttgcatttccttattagtgatattaacttttaaaaacagttatcaatttgtgtattttctttggtgaattgtctctttgtatgcaaaatataattttttaattataaaagaaatcaaggaaaaggtatgctttacacactatgcttattttctgcctttttttaaaaaaaaaataaaagtaacttcaacatttattttagattcagaggggtacatgtgcaggcttgttacatgggtctattgcgtgatgctgaggtttgggatatggatgatcccatcatgtaggtagtgagcatagtacctaagaggtagtttttcagcccacactccctttctccttctcctctctagtagtctccagtgttgatcgttgtttccatttgtatgtctatgtgtactcagttcttagctcccacttataagtgaaagcatgtggtatttggttttctggtcctgcattattttgtttaggattagcctgccgctgtatccatgttgctgcaaatgacatttcattatttgtatagctgtgcagcattctaaggtgaacatataccacagtttccttattcagtctactactgatgggcacttgggttgattccatgtctttggtattgtgaatggtgcagcaatgaacattcaagtacatgtgtctttttggtagaacaatttattttcttctgggtgtatacccagtaattgggttactggttgaatggtagctccgttttatgttctttgagaaatttacagactgccttccacagtggctggactaattttcattctgacagtgtgtaagcatttgcttttctccatggcctcaccagcatatgtcattttttgactttttaatatagcaattctgactggtgtgagatggttttccattgtggttttcatttgaatttctctaatgattagtgatgatgaggattttttcatgtttgttgtatgttttcttttgagatgtgtctgttcatgtccttttcccatttttgatgggattatttctttattgcttgttgatttttttaagttccctatagattctggatattaggtctttgttggatgcatagtttgtgaatatctgctcccattctttaggtagtttgtttgctctattgatagtttcttttgttgtacagaagttctttcgtttaattagggctcacttgtctatttttgttttagttacaattgcttttggggatttagcccaaaattctttgccaaggcctctgtcatgaagagtatttcctatgttgtcttccaggatttttatagtgtgaggtcttacatttaaatctttaatccattttgagttaattttttacatgtggtgaagggtagtggtccagcttcaatcttctgtatatggctagccagttatcccagcatcatttattgaaaagggagtccttttcccattgcctatttttgtcagccatgtcaaaaatcagatggttgtagttttgccactttatttctgtgttttcttttctcttccatttgtctatgtgtatgttttcataccagtagcaagctgttttgggtactgtggctttacaatatagattaaggtctggtagtgtggtgcctccagttttgttctttttgcttaggattgttttggctatttgagctctttttttgtttcatatgaattttaaaatagtttcttctaattctgtgaagaatgacattggcagtttgatagaagtaaccttgaatctataaatttctttgggcagtatggccatttttatattgcttcttctaatccatgaccatggaatgtttttccatttattcatgttgtctctgatttctttcaacagtgttttggagttctccttgtggagatatttcaccctcttggttagctgtgttcctaagtattttaatttctttgtagtgattgtaagtgggattgttttcttgatttcactctcagcctggacattgttggtttatagaaatgctgctgatttttgtacattgatctttgcatcctgaaactttactacaatttttccttttttttctttcttttttttttgctaaagtggtttatgaattttgggagccttttggcagagtctttagggttttctaggtatagaatcattttgtcagagaagatagtttgatttcttctttgcctatttggatgccttttatttctttctcttgactgattgctctggctagggcttccaatactattttgaataggagtggggagagtggacatatttgtcttgttacagttctcccagggaataatgctttcagcttttgtctcttcagtatgacattggctatgggtttgtcatagatggctcttattattttgaagtatgttcttttaacacatagtctgttgagtgtttttatcatgaagggatgttggattttatctaaagctttttctgcatctattgagatgatcctatggcttttggttttaattctgtttatgtgatggatcacatttattgatttgtatatattgaaccaacctcacatcacaggaataaagcctatttgatcttggcaaattaactttttaatgttgattcaccaagatcaagtagaatttattctggagcctacggactggcgctgacattgtagaatgagtaagggaggagcccctcatccctgattttttagaatagtttcagtaggattggtacccatttttctttgcatgtctggtaaaatttggctgagaatctatctggtctggggctttctttgattggtagtttttttttttcaattgttgattcaattttgaatgtgttattgttccgttcaggttttcactttcttcctggatcaatcttgggagattgtatgtttccacgaatttatccatttcctgtagattttctaatttctgtgcatcaagttgttcataatagtctctgaggatcttttgtatttctgtggtatcaattgtaatgtcatctttgtcacttctgattttgcttatttagatcttctgggtttttttcattattagtctagctagagatctatgaattttgtttattcttttgaagatctaggtcttggtttcattgatcttttgcatggatttttgcatttcaatttcatttagttgttctctaattttaattatttatttctctgttatctttggggttggttcttttttttttttaagttcctctaagtatggtgttggattgttaacttgaggtctttctaacttcttgatgaaggtgtttagcactataaactatctccttttaacactgttttagctgcatcccaaagattttggtaagttgtgtctatattttcattaatttcaaagaattttttttatttctgccttaattattttgttcatgcaagagttactgaggagcaagttgtttaatttctctgtatttgtatagttttgagagatcttcttggtattgatttccatttttattatggtgtggtccaagagtgtgcacagtatgatatcaacttttttgaatttattgagacttccttaatgattgagcatatggttgatattagaatatgttccatgtgcagatgagaagaatatatattctgttgcagttgggtatagtattctttaaatgtctattgggtccaattggctgagtgtcatgtttaaatccataatttttttgttcatttctgcctcaatgatatgtcagtaaagtctgtcagtggagtgttgaagttttccattattattgtgtgggtcttcttgtagttgttttatgaatctggatgctccaatgttgggtacatatatgtttatgatagttaaatcttcttgttaaatcaaaacctttcattatgtaatgtccttctttctgctttttgtttgttgatgttttaaagtttgttttatctgatataagaatagtgagtagtgctcttttttccttcctgtttgcacggtagatcctgctacttttagcctgtggatgtcattacgtatgagatggatctctaaatgatggcagagagtttgatcttgtctttttatccagttggccactctatgccttttaagtggggtgtttagactgtttacattcagggttattattgatatctgagattttgaccctgtcatcatattgttagctggttgttttgtagaattgattgtgtagtttctttatagtgtctgtgggctatgtgcttaagtgtgtttttgtggtagcaggtatcattcttttgtttccatgtatagcactctgttaaggacctcttgtaaggttggtctagtggtaataaattccctcagtatttgcttgtctgagaaggattttatttctcttttgcttttgaagcttagtttggcagaatatgaaactgttggtatgaaatttctttttttttttttaaggatactggaaacaggctccctatgtcttctgccttgtaagaattctgctgagaagtccactgctagcttgatgggattccctttgtaaatgaacggatccttctctctagctacctttatgatgttctcttttgcatttaccttgatgattctggtaactatgttccttggggattgtcatcttgtatagtattttgcaggggttcttggtatttcttgaatttgcatgccagcctgtctagcaagattggagaaatgttcatggattaataataatgtcaatgacttgtaggtttggtctctttatataaccatatatttctcagatgttttgttcattttttaaaaattattttttaaaaaatttttatctgagtttactcaaataactggtcttcaagctctgagattctttctgtggcttggtctattctgctgttaatgcttcttattgtattatgaaattctcatagtgaattttttcaattccagaagttcagtttggttcttttttgaaatggctattttgtcttttagctcttggatcattttactggattccgtgaatttctggattgggtttgaatgttcttcttgatctcaatgagcttccttgccatccacaatgaattctatgtgtgtcattttagtcatttcaaactgattggataccattgcttatgagctagggtgcttatttggagggaaaggaacactctgactttttgaattctcaggtttcttgcatggattctttctcatttgagaggactggtgtttctttagctgtagcataagttgagtataatcaattggctttgtttctgggcgctttcagggtgccaatgctctgtacaggatctgtacttaaagctggatttttgccccttctctaggagctatttggggccaggaactgtccctgacatttgacaaatctatgcagggttcccagcttcctccctcttcagccttggggtctgcctcacctctcttttgactcttggtattttctctttgaaaatctgttcaaaatatgttagcttacccaatttttggtctttcttggtgacagcagtgcttcctgactgtgtccagttggacgtcttgtccagaacccctggtgattatttttaaaatgaagctttgttgtagcactcttggccaatttaatataatgtccttttttccctttataagttagccttcatgtcttcagtctacacttagacattcaggtcctaaatattacctttgcatattcagtatacaccagctccattcatagctgaacacttcaccaggttcctaattcctgaaagaacagaagccatatctgtatcccaggaggctggggcgacaagatggtggatctccccttattttcttttcatacattttttcaccaaaatttgacttgtatttgcagctatctgctatcaaacactagaagttattctttctcactgtatttttgtagctatcaaccaacttttcttcatccctctctcccctctacttttctcaacctctgttaaccactattctactttttagctccatggcataagtattttttagttcccacatatgaattataacatacaatatttttctttttgtgcctggcttatttaacataatatcctccagttccatctatgttgctgcagaatgacaggatttcattctttttatggctgaatattccattgtgcgtatataacacattatccatttatctgttggtggacatttagcttgattccatatcttggctatggtgaatagtgttgcaacaaatataggagtacagatacctctgcaatatatttatttactttcttttggacatatacccagcagtgggatttctggatcatatggtagttctactgtttataaattttttgtactggctgtgctaattctaattcccaccgtaagtatatgaatgttcccctttctctgcatctttaccagcatctgttattttgtgtctttttgataatagccattttaactgaggtgagttaataattcattgtagttttgatttgcagttccttgatgattagcaatgttgaacattttttttttcatatacctattggccatttgtatgtcttcttttgagaaatgtctattcagatcttttgcccattaaaaaaaaatcagattgttattaatattatttttgctattgatttccttatgtattttggttgttaatcccttggcacatgtataatttgcacatattttctcctattttgtaggttatgcattcatttgtttattgtttttgttttttgctatgcaaaactttttagtgtgatgtaatcctatttgtctctgagtcttcttatccttatcttagaaatgaatctaatactatttgtctgtctgtgttgttggctgtgcttttgaggtcttactcaaaaaatatttgctaagattgttatcctaaagtatttcctcattgttttcccctagtagtttcatagttttggttcttatattaagtttttaatccatttttattttatttttgtatgggctaagagataggggtctaattttattgttctgcatatgggtgtccagtttttcccacaccaatcattgaagagactatcctttccccagtgtatgttcttgatgcctctgtcaaaaatgagttggctataaatgcctgggtttatttctgggttctctatttttttccattggtctatgtatctgtttttgtgccagtaccatgtaactctggttactatagctttatagtacattttcaaatcaggcagtgtaatgcctccagctttgttctttttgctcaagactgctttgggtattccaggagaatgacatttttgaagaatactagccaattattttatgcaatatccctcaatttagaatttttagatgcttcttcatgagtaaatttagatgatgcatatttggccagaatagcatactgcatccttctcagtgcattgtatcaggaggtatgtgatatcaatttctcccagttgtggtgataccagctttgatcacttggttaaggggaaatctgtcaggtttctgaaaagagttcctgttttcctttgtatttaataagtatcttgtggggagatattttgagactgtgtaagtatcctgttccacatgataatctccttcactaagtttagcacctgttggtacttacctacaacagttattaccgtggtgtttgccaaatggtgattttctactctcatcacttcttatacatttatttctccaaatactgctgtgagaaagagtttaccatgctctcctatttatatatttacttatttataacattgtggtctcatggattcttactttattctatgggttataatccattactgttgttatttatgttgttgatcaaactgttttaagatttgcccattgggagactgttccatttgactcttgactttttttttttacatgcccttgttatttattgtgctattccttattttcttttataagttgatcttatacttttctttgtctggaattagccatttctccaaggaaatctgatgacttttactggaggaaggtacttagaaatcatgatctggaccgtgttctattttatcttctccctatgagttaggcacaattagcaatcctacatttttaatgaaataactgagaactcaagaagttaaataatacatctgatgccacacaactgaaggtgatagaactactatttgaacccagtctaaagtttggtctccagtgtccatacttaaatttaatttctctctgggattggaaagcttttccagtgtctctgagtcttcttttccttgtcttagcaatgagtctagtactatttgcctctcagtgttgttgtgatggctaaatgaaaggacacatcggaaattgtctatacattatttgttccatagtggatactcaaatatacgttgaatttgagctatattcactcagtattcataaacacccactttgttcgcagcactgaggtagaaaatatgcaggtacatgcatatttcctggtaagagctcatatttcctggcaataatttctaatgtcactccttcctgtgcatccaatataggataccagaatcctttccaagatagaatttaggcagacactactgaacaaatgaaacgtatttgctgccctagacatgagtgatgaagggttgggagaacaggcgtgactctaccaaaaacaggcagataatccaggctcacatttcaaaacaccttgcaacttaagtttctaaccattttctaacagtccttgaaattatgctaatataaggacttccaggcaacatagaagactgggtgtacatgctaatacacaaatgacatagaggatcagcatcccaacttcttggaatatgccagacagtaataaatgtaacagccacaaaattccagccttgcttaatttggggaaatgagaatcagtttgttcttcccctgctggcactgaacagtggtttgcaggatcactgcgtgggaaagatctgacagtagagatctgagaggctgtctgtgtgaaggctgaatttcatgaactatctcattgttgggatggttccctttcagcctcgtggtaagtacaacactcaggtcactgtaagcgcagggcaggcaagcttaagccacaatgagtgaaaatatgtgtgtattgggttgggggaagggattttagtctggattatctgaagctcagactttaagctgagagcctgggctgccaagcaggtatatgtaaaggacagctcaaagctgaggtttaaaactagtatgctccaaccaggctgtgaaagtaactaaagtagctgagtgcctcagatcacctaatgtttatttttgttttgttttattttttgtttttccatttttgttgttgtttgtttgttgttttttctgagacagagtctggctttgttgtctaggctggagtggagtggcacgatctcggctcactgcaacctccgcctcccggattcaagcgattctcctgcctcaacctcctgagtagctgagactacaagcgtgtgccaccacgcttggctaatttttgtatttttagtagaaacggggtttcaccaagttagccaggctgttctcgaactcctgacctcagggaatccacccaccttggcctcccaaagtgctgggattacaggcgtgagccaccacccccagccgccctaatgttttacaagtttgagacataaacctgtggcatgcttttttttgggaacatgattcagaaatcactttttcctatcaaaaagcagaaaaatgagccatgatgattggaatccttcctgatcttataggtagactgggaaagcatagctgggaagagcacagacagggagatcagaagaacctcggactgccacaaaatgtgtaatgccaggtaacctaagccagccagtcaatttatctggggatcacttcttcacttgtacagcgaacaagatgaattagataattgtataattccttggagctctgaaattctactgcacaaatagatgcctcgtgatcgctgttgagatgaggtcttccagagcctgtgatcccagatgtgattgatcatcttgccagagctttagccaccttctcacctgttagacaattcctgcccctgtgtctctactgtatcgcctttcacagctcatatgctgcacctatgcagtcttcttcagggtaagctgtgtgaagtttaagtttcttataactattaaacttcatcttgcaaaggattcttcctttgaagaccaggttgcaaagtaaataaaaatgaaactacacttgataaagcagggatgggaagtctgtaaccttatccttattgtgggatatttgaattgtctctattttttgctatttgtcttcaagttgtcctaagaaggtgggatcaatatcccccatcctattggttcagagtcaagactaatgatgccacacatgcatgaagagtgtatggaaacatttattatttacatcatgaggctttctagggagagcagaggaaacacccaagcttttctattagatttgagtgaggaaggcacaagtggctttggtttctactgtgtgtgggtgtgggctggcattagggctcccgtgtacaggctcaagtttacgtggtttgacttctatgctagtgccaaggaaaggagggcctgggatttttttttaattggcttgctcatgtgtgaggggaaaagagaagtgggagaaaaggggtctgaaagctgtcagcagccagataatggagtcagatgatcttacatattagaaaattccaaggaaaccactaaaaacctattagaactaatacatgagttagcaagattgcaagatacaagatcaatatgtgaaaaatcaattttctttctatacatttacaaagaactatccaaaaatgaaattaagagaataatttcattcacaatagtatataaatatattaaatatataggaataaatttaatataatgtgtaaaacttacatggtgaaaactcaaaacattaaaaaattaaagaagagcaaaataatagaaagtccatattcatgaattaaaagtcttaatattatcaaaatgacaatatttctcaaatttatctagattcagcacaattcctatcaaaatctcagctggcttttttttttttgcagaaattgaccagctaattttaaaattcatattgaaaagcaagggatccagaataacaaaaataatcttgaaaaagaagacaaagtaggatgacttgctggtatggtttggttctgtgtccccacacaggtctcctcttaaattgtaatcttgtaattcccatatgttatgggagggacccagtgggagatgatttgaatcatggggatagtttcgcccatactgttctcgtggtagtgaataagtctcacgagatctgatggttttatcaggggtttctgcttttgcatcttcctcattttctcctgctgccactatgtaagaagtgcctttcatctcctgccatgattctgaggcctccccagccatgtgcaactgtaagtccaattaaacctctttttcttcccagtatcgggtatgtctttatcagcagtgtgaaaacggactaatacactcacacttcccaatttcaaaacttcaaaaacagttatgaagaaagtatagtactagtatgaggataaatgtatagatcaatgtaataaagttaaaaattcagaaataaagccttacatttaaggtcaattaatttttgacagtggtgccaagacatttcaatgggaaaagaacaaccttttcgacaaatgatgatgaggcaacagaatatgcctgtactcataaataaagtttcaccccttccttatacaatatacaaaaattaactcaaaatggatcatagactaaatgtaacagctaaaatgataaaatttttagaagaaaacataggagtaagtcttcatgaccttgggctaaacttcttagcaatgataccaaaagcaaagcaaccaaagaaaaaatagtgacccttagaatcaccattaaataggaagatagtaccccttgtattatgggccttaatttctataggccttgtttttttaatctgtattgggacatattaactattttaaccagagatggattattctattttaggttcgtggtattccatttttttaagctgattttcaatgtcaaagatttaattttatttcaatttattactcattgggttaggtcatatctactacgtgatatatgttaaggcaacaggtgctaaggccatggagaatttagagaaggaaagtgtaccagtagtcaaggtgaggcatacctgtttgccctctactttg
